United States Patent 11,453,907 (CRISPR EFFECTOR SYSTEM BASED CORONAVIRUS DIAGNOSTICS) - sequence listing, part 3

SEQ ID NO: 61839 - protein, 1473 aa, Unknown
  Microbial source - Accession No. Ga0302246_1000265
MPQQAKPPVTQRAYTLRLRGAGPSDISWRKALWQTHEAVNKGAKAFGDWLLTLRGGLDHTLADAKVKGEKGNPDRDPTDEKRKARRILLALSWLSVESKLGAPAGFIIASGTEAAEDRNGKVVAALEEILKSRNLAENEIDEWKNDCSASLTAAIRDDAVWVNRSRAFDDAVESVGCSLTREEAWDMLERFFGSRDAYLAPAKVTEDESSEEEQEEKAKDLVQKAGQWLSSRFGTGKGADFSRMAAVYGKIAAWADNAQAGTTGNQAINKLAADLSEFTPASNDLQGVLGLISGPGYKSATRNLLNGLATKTTVTQQDFGSLRDKAADDAQKCKQNTGSKGQRPYSDAILKDVEAVCGFTYLQQDGGAARHSEFAVILDHAARRVSLAHTWIKRAEAERRRFEEDTQRLANVPGPVKAWLDSFCSERSATSGALEPYRIRRRAVDGWKEVVTAWSKSSCSTSADRIAAARALQDDPEIDKFGDIQLFEALAEDDAVCVWHKDGDAAKAPDPQSLIDYALAAEAEFKKRHFKVPAYRHPDALLHPIFCDFGKSRWDICFDVHKNVQTPFPRALCLTLWTGSGMVSVPLCWQSKRLARDLAIGSNATNAGYVEVARADRLGRAASNVTKSDEVKISGLFEQADWNGRLQAPRQQLEAIAVVRDNLSLSAQERERRMSSMKDRIRWLVTFSAKLQPQGPWCEFAKTNQLRIDPQYWPHADSNKTRKGQARLILSRLPGLRVLSVDLGHRYAAACAVWEAVNAEQVKKACQVAGHEAPKASDLYLHLKRKATKRKKGNQVVVEETTIYRRIGADTLPDGTQHPAPWARLDRQFLIKLQGEEEGVREASNEEVLKVYHLEAELGRTAPIIDRLVKAGWGQSGKQRTRLEALRELGWKPASEAVVSDGMGADEGEVRKPSLSVDELMSSAVRTMRLALKRHGDRARIAHYLITDEKTRPGGVKEKLNENGRIDLLQDALLMWHDLFSSRGWRDDVARQLWDNHVAKLSGYKAPEEIGEESSGPERKKRQKENREKLHDVAKALAQDVTLREALHDAWKKRWKDDDERWKKQLRWFKDWVLPRGKHASDPAIRKVGGLSLPRLATLTEFRRKVQVGFFTRLQPDGTRAETKEQFGQSALDALEHLREQRVKQLASRIAEAALGIGRMRRPMGGKDPKRPNGRVDEPCHAIVIEDLTHYRPEETRTRRENRQLMTWSSSKVKKYLAEACQLHGLHLREVSASYTSRQDSRTGAPGIRCQDVPVKEFMRLPFWRKQIAQTEKKQAEGKGDARERFLCYLNAKWKGKSEADWEKAGVIRVPVRGGEIFVSASRDSQGAKSLQADLNAAANIGLRALTDPDWPGKWWYVPCDPASFRPIKDKVEGSAAVKPDQALRQSAQAQSGDAAKDKKKRGNKSAGKSKEVINLWRNISSSPLECIEFGEWKEYAAYQNEVQCRVIRILEEQIKGRDKQLHEGAKEDDISF

SEQ ID NO: 61840 - protein, 1536 aa, Unknown
  Microbial source - Accession No. Ga030221_1001844
MPDQTNPPLTQRAYTLRLKGAQKDDTSWRCALWQTHEAVNKGARVFGDWLLTLRGGLDHTLADASLKSGQEKPDSTLTDEERKARRILLALSWLSVESKTGAPENFIVASGQDSEKNRADCVISALKEILESRKVDKNELDAWINDCSASLSSAIRDDAVWVNRSKAFDEAVKSIGPSLTREEVWDILGCFFGSREAYLAPGQSSDEDESSEAEQEDKAKDLVQKAGQWLSSRFGTGKGANFSHMSKVYEKISGWADSAQAEMTSKEAINDLAAALSEFAPASNDSAGVLALIKGPGYKSATRNLLSLIALQTTVTQEDLTKLKELAAKDKVECATKIGAKGHRAYSDKILEDVESACGFTYLQQSEEESARHSEFAVMLDHAARRVSLAHTWIKRAEAERKKFEKDSKKINCLPEAVRTWFDNFCIDRSELSGALEPYRIRRRAIDGWEKVVAEWSKPSCGNCADRITAARMLQDDPDIGKFGDIQLFEALAEDDALCVWHKNGNINEASDPQLLIDYAAATEADFKKRKFKVPAYRHPDALLHPVFCDFGNSRWDIDFSIKKAFNDLDKQKALLNKKEEEIIRAEQKLNIKNSKDVESQKKLQQEKEKLKKIQQKIAWLEEKNGVEMALLNNGKIGKMALRWQSKRLTRDLALDQSDNDCGVSHDVSRADRLGRAASNATGGKVNILEIFNQDYWNGRLQAPRQQLQDIAAVRDNPSLQAAERERRMSIMKDRIQWIVTFSAKLRPKGPWCEFAELNQLNIDPKYYPHAKENRGRKGMAKLILCRLPGLRILSVDLGHRYAAACAVWEAVSADDVKLSCACAGHEEPNERELYLHLKEKKSVEQKNGGKTETEQTIIYRRIASDTLPDGTPHPAPWARLERQFLIRLQGEDEIVREASNEEIFNVHRAEAELGRTVPLIDRLDKAGWGKSRKQKERLDGLRKLGWERVSDGTAQDVPDTGEDYWAKPSLSVDELMSSALRTLCIALKRHSDRARIASAMTAEYKTMPGGRKYYFTGPRELSASDDKSTIDNKHIEFIQDALVLWDGLMTSRGWRDDAAKQLWNNHIAKLSGYKAPEEISDESSKTERKNKQKENREKLRGAAAALVSDTNLREALHAAWKKIWEDDDELWKKRLRWFKDWILPRGKAAKDPAIRKVGGLSLARIATLTEFRRKVQVGFFTRLHPDGTKTEITEQFGQSALDALDRLREQRVKQLASRIAEAALGVGRVPRTKGGKTPKRPSARVDEPCHAIVIEDLSNYRPEETRTRRENRQLMSWSSSKVKKYLSEACQLYGLHLREVSAGYTSRQDSRTGAPGIRCQDVPLTEFILSPFWRKQVAQAEGKGDARDVLIRDLNHMLEDKSASDGEKPKVLRIPLKGGELFVSADKKSPASKGLQADLNAAANIGLRALTDPDWPGRWWYIPCEPGSFRPVKDRVEGSAAVDPNRALRQDAQPQGSDAAADKKKRAKKSTGKSQEKEIINLWRDISSSRPDDTAAGKWQTYDEYQNRVQYRVVDILREQANERKKRTSSRCDKP

SEQ ID NO: 61841 - protein, 1503 aa, Unknown
  Microbial source - Accession No. Ga0302253_1002416
MPQQDKPPVTQRAYTLRLRGTDPSDTSWRDVLWRTHEAVNKGAKEFGDWLLTLRGGLDHTLADTKVKGGKGKPDRDPTDEERKARRILLALSWLSVESKLGAPAGLIIASGKETTEDRNGRVVAALEEILKSRGAEDKIDEWKNDCSASLSAAIRDDAVWVNRSKAFDEAVKSVGCSLTREEVWDMLERFFGSRDAYLAPAKGSEDESSQTEQEDKAKDLVQKAGQWLSSRFGTGKGADFSRMAGVYQKIADWAGAHSPNNAGTGAIAGLASALSEFTPASNDLNGVLGLISGPGYKSATRNLLTQIDAKTTVTQADLTKLNETAAADKGKCETNTGSKGRRPYSDAILKDVESVCGLTYRVDENGNAVSVSNYSLYGDEYNWGSARHSEFAVILDHAARRVSLAHTWIKRAEAERSKFEEDAKKVDQVSKAAKDWLDKFCLERSGMSGALEPYRIRRRAVDGWKEVVAAWSKSSCSTSADRIATARALQDDPEIDKFGDIQLFEALAEDDAVCVWHKDGDAAKAPDPQPLIDYALAAEAEFKKRHFKVPAYRHPVALLHPIFCDFGKSRWDICFDVHKNVQTPFPRALCLTLWTGSEMKPVPLCWQSKRLACDLALGNNERNAGASAVTRADRLGRAASNVTKNDEVNIAGLFEQADWNGRLQAPRQQFEAIAAVRDNLSLSAKEREQRMSGMKDRIRWLVTFSARLQPQGPWCDFAETNQLRIDPQYWPHADANKTRKGQARLILSRLPGLRVLSVDLGHRYAAACAVWEALSAEKVKEACHAAGRKEPTENDLYLHLKKKVKKQKKAKAVEVEETTVYRRIGADTLLGGTQHPAPWARLDRQFLIKLQGEEEGVREASNEEVWKVYQLEAELGRTSPIIDRLVKAGWGQSNKQQTRLDALRELGWKPASGAGVSDGTDEDEAEVRKPSLSIDELMSSAVRTMRLALKRHGDRARIAFAMTAEYKPMPGDRKYYFTEAKELSANDDQATRDNKHIEFIQDALVLWHGLASSRGWRDDAAKQLWDDHVAKLSGYKAPEEIGEDASGVERKKKQKENRERLHDVAKALAEDTTLRKTLHDAWETRWEDDDEQWRKQLRWFKDWILPRGKAVDDPAIRKVGGLSLTRLATLTEFRRKVQVGFFTRLHPDGTRAETKEQFGQSALDALEHLREQRVKQLASRIAEAALGIGRMRRPMGGKDPKRPDVRIDEPCQAIVIEDLTHYRPEETRTRRENRQLMTWSSSKVKKYLAEACQLHGLHLREVSASYTSRQDSRTGTPGIRCQDVPVKEFMRSPFWRKQIAQAERKQAEGKGDSRERFLCDLNVMWKDKAVADWEKAGVARVPLKGGEIFVSADPASPAAKGLQADLNAAANIGLRALTDPDWPGKWWYVPCEPGSFSPVKDKVEGSAAVKPDQALRQPAPAQSSDAKDKKKRGKKGAGKSKEVVNLWRDISSSPLECIEFGEWKEYAAYQNEVQCRVVRVLEEEIKGRDKQPHDGAKEDDILF

SEQ ID NO: 61842 - protein, 1042 aa, Unknown
  Microbial source - Accession No. Ga0307340_100872
QQSEEESARHSEFAVMLDHAARRVSLAHTWIKRAEAERNKFEKDSKKINCLPEAVRTWFDNFCIDRSELSGALEPYRIRRRAIDGWEKVVAEWSKPSCGNCADRITAARMLQDDPDIGKFGDIQLFEALAEDDALCVWHKNGNINEASDPQLLIDYAAATEADFKKRKFKVPAYRHPDALLHPVFCDFGNSRWDIDFSIKKAFNDLDKQKALLNKKEEEIIRAKQKLNIKNSKDVESQKKLQQEKEKLKKIQQKIAWLEEKNGVEMALLNNGKIGKMALRWQSKRLTRDLALDQSDNDCGVSHDVSRADRLGRAASNATGGKVNILEIFNQDYWNGRLQAPRQQLQDIAAVRDNPSLQAAERERRMSIMKDRIQWIVTFSAKLRPKGPWCEFAELNQLNIDPKYYPHAKENRGRKGMAKLILCRLPGLRILSVDLGHRYAAACAVWEAVSADDVKLSCACAGHEEPNERELYLHLKEKKSVEQKNGGKTETEQTIIYRRIASDTLPDGTPHPAPWARLERQFLIRLQGEDEIVREASNEEIFNVHRAEAELGRTVPLIDRLDKAGWGKSRKQKERLDGLRKLGWERVSDGTAQDVPDTGEDYWAKPSLSVDELMSSALRTLCIALKRHSDRARIASAMTAEYKTMPGGRKYYFTGPRELSASDDKSTIDNKHIEFIQDALVLWHGLMTSRGWRDDVAKQLWNNHIAKLSGYKAPEEISDESSKTERKNKQKENREKLRGAAAALVSDTNLREALHAAWKKRWEEDDEMWRKRLRWFKDWILPRGKAAKDPAIRKVGGLSLARIATLTEFRRKVQVGFFTRLHPDGTKTEITEQFGQSALDALDRLREQRVKQLASRIAEAALGVGRVPRTKGGKTPKRPSARVDEPCHAIVIEDLTNYRPEETRTRRENRQLMSWSSSKVKKYLSEACQLYGLHLREVSAGYTSRQDSRTGAPGIRCQDVPLTEFILSPFWRKQVAQAEGKGDARDVLIRDLNHMLEDKSASDGEKPKVLRIPLKGGELFVSADKKSPASKGLQADLNAAAN

SEQ ID NO: 61843 - protein, 550 aa, Unknown
  Microbial source - Accession No. Ga0308310_1004946
LGDVLTKQTTRVIVPLVGFEARLLNIKSTHVAVHAKLEFLSNEDKREVLDLMRRFSSAYRWIYKRIVEGGNPAELKRAFGPMDKFGLNSRYKDSAVQLALVKLRTMESLGVNPKKVIFGSRRLFERLCRKGDLKSRAKAKRKWRERRKGVLKGLGSKADISGNVNLTPLLINGELWLRINIKTGTNPESGKKESRYVYAKVKTSHPYLSHILEVVGKRGAVPISVHLKLIDGKVYAIFTKKIDLPEPVLTKYYGVLGVDINARPLHLALAVVEPDGNLRKYTTISLEEVIRIRERYKGKSSNVLDNFYWLVAHQVVDLAKNEGVAIAIEDISNLPKGFRGDGNKKLRRILHRFAYRSILERIVRVASREGVEVWGVNPAYTSVIGMLKYAPMYSLSKDVAAAYVIGRRALGFSEKVPKRYLQLMASPEYRGSVINWFNQELSALEKRIGGERNEYKLNRLRKEKESLEKAFNWLNRFLSPGGSPEGLQRGLTYGRNPEEPKGDSLHLWKALQVGVLRPLLGQKVPRDLSVLKPLLVGGVWKCGKVEEGYT

SEQ ID NO: 61844 - protein, 552 aa, Unknown
  Microbial source - Accession No. Ga0308310_1013800
LGDVLTKETTRVIVPLVGFEAKLLNIKSTHVAVHAKLEFLSNEDKREVLDLMRRFSSAYRWIYNRLVEGGNPSEIIQVSGPVSRFGLNSYYYLSARELALYKISSLEAKGVNPRKIIFGTRTLFNRLCRKGSLKSRAEAKRVWRERRKGILLNFGNKKSVSGNYALTLSLINRELWLKINMGTSKNPKSGKKKSRYIYAKVKTSHPYLNHIMEVVGRSGIAPISVYLKLIDGKVYAIFTKKIDLPEPVLTRYYGVLGVDINARPLHLALAVVEPDGNLRKYTTISLEEVIRIRERYKEESSKVLDNFYWQVAHQVVDLAKNEGVAIAIENIFNLPKGFRGDGNKKLRRILGRFAYRSILERIVRVASREGVEVWGVNPAYTSVIGMLKYAPMHSLSKDVAAAYVIGRRALGFSEKVPKRYLQLMASPEYREAVINWFNQELRALEEKMGGERNEYKLNRLRREKESLEKAFNHLNRFLSLEGSPEGLQRGLTCGRNPEEPNKGDSLHLWKALQVGVLRPLLGQKVPRDLSVLKPLLIGGVWKGGGGLHLGPS

SEQ ID NO: 61845 - protein, 556 aa, Unknown
  Microbial source - Accession No. Ga0308411_10001123
MAFGRMAGPTIVYRYGAKKPTTNAEAMLEQLRKAHQYRNKLVELELQRRKLVEDAVKSIESEVRQMADKIEQLELDIDYVARKISSHKQKNRTRTVPTELKEQLKALKAQRRETLRQMREAKKAAYTRPETQEALSRIEGKARAEHKKARSLCGLYWGTYCHVEQIISQIRKGPPPKFRRFDGSGVLAVQLQKGEDIARLESGEDRRIRIEGYGKRRILWLRIGSDENHNPIWATIPFTYHREIPHNAKIKWVKVKAKRIACQIDWEVLFTLERSSGWKKPDLAQDGAVAIDIGWRNFDDRIRVAYWVGSDGFEGEIALPSNMVSKALEQVEHLRSLRDKNFNEIKQQLLDAIGALQIPEWLTEATKTLHQWRSQGRLASLTIRWRQQRFEGDNDIFNLLETWRVRDKHLYEWEAHLRMKAIRRRDDYFANVAADLSRRYKTAIVEDFDLRNVTQIDPTQTEQIGDGRQRYRARIAAAGNLRQMIKNRFAETQIVSAALTTQTCTECGEIMNFDAAESVFGKCPHCGHAFDQDRAAAINLMRRYEGKLVAASGEVR

SEQ ID NO: 61846 - protein, 1193 aa, Unknown
  Microbial source - Accession No. Ga0308411_10021369
DKNEVKMFNDIKARMRHHISKALTAHEGFSKLNKDDLFKKKKNANESLLENFLNQNEKVRNKLNELLRDNEGDRVDLFELLRAFENFTTYFRNFHENRQNLYSPEDKFSTIPHRLIHENLPRFCDNIKIYNQAKAAGLNMNDIEKELRLNNNSLDEIFSIKYFTKTLTQSGIDFYNYIIGGGAIQSGSQNIKGINNFINNDINQNVNNSSGRIPIMKTLYKLPLFERTSYSFRYEPIENDKDLIERIKNFYYEDLKNHRDVDDNENNQVNVISAIKSLIENIHDYREGLYVNGGITLTQISQKIFGSWHYIRDVLSEYYDKSIVPVKLDKKRTKAEEKAKEKWLKQKQFSVKIIEDALCAYKKEKETNEEIIKKITETTICDFFKLAGADDNGSNNLFERIESKLTIKNEYDESLADLLGKEFQNERNLMQDKPRTLLIKNFLDTLQGYKDDITAGLLHFIKSLLPSEEISDKNELFYSEFEKYYNILKEVTPLYNKVRNYLTQKPYSVEKVKLNFENNTLLAGWDENKEADNSCVLLRKNNNYYLGIMKKEFNNVFKKDKYLIANDNEPCYEKMIYKLLPGANKMLPKVFFADRNINEFNPSEEILRIRNTASFSKNGTPQEGFNKAQFNLEDCRKLIDFYKKCISNHCDWKNFNFQFSDTDSYQSIDEFYREVEQQGYKVNFVKIPDRYINQLVDEGQLFLFKIYNKDFSDKKKTNGKPNLHTLYWKMLFDENNLKNVRFKLNGEAEIFFRPKSINYTDEIWEKGHHYDKLKDKFNFPIISNKRYALDKFHFHVPITINFKSNNQENINEIVNNYLKNSDKYNIIGIDRGERNLLYVTVINLKGEIIEQFSLNEISTNYRDKCFSKDYHEELDKRESQRDRARKDWQTIEGIRNLKEGFLSHVIHKISQLVIKYNGVVVMEDLNFGFKRGRQKVEKQVYQNFEKMLINKLNYLVFKDKEPDEPGGVLNGYQLVNKFKTFKELGKQSGIVFYVPAAYTSSIDPLTGYVQYLFPIKHANSVEKARNFYSKFKSIYYNPEKEWFEFVFDYIDFNIRFEGKSDWKICTANTERYVWNKNLNSGRGGQEKINVTEGLKLLFREYNILYCDGKNLRELISEVRSINNENTDKKFYNRLNYLLNATLKLRHNNGKQGAEEKDYILSPVKPFFDSRSANKTLPKNADANGAYNIARKGL

SEQ ID NO: 61847 - protein, 1261 aa, Unknown
  Microbial source - Accession No. Ga0308414_1002480
MNFDEFTNLYSISKTLRFELKPVGKTLDWITKNKLVEEDEKRAEDYKTVKKIIDRYHKEFIEEAFESALNANSFQRDMKDLIESYSELYYKEDKSDKDKKELENISSQMRQEIVSCFEGNYSDEVKKKFSNLFKKELIKQDLLNFCQPSEKEVIEKFADFTTYFGGFHENRKNMYSSEEKSTAISHRIVHENLPRFLDNLKVFNSLKEEYQDFPWNQLEFNLKNIDPSLKLEDYFSKKGFILTFTQKGIDRYNLILGGKSLDSGQKVQGLNELINLYRQKKCLDRRKIPNLKELYKQILSDRVKFSFIPEKFLSDNSLLEAIRNFHEEVINAKIEIDSKQVNFLEALKNTIQGIKAHKLEKIYISNDLGLTNISNFLYGEWSKIKSALFYYYDEKIADKGKGDKQSKKYQEGREKWIKKDYYSVQKLNEAITLYSKYSEDGFEATPLEEYFSKFKTRDENRAELDILSNIEQSYSELKPLLEKEYLKNKNLKSDKYNIEKIKNYMDSIKILQNFLKPLTPKKILEEKDLGFYNEFETYVESLQSFNRLYNKVRNYLTEKEYSVEKFKLNFENSTLLNGWDENKESANLGIILRDEDKYYLGIMNKNYKKIFSNIPKLKSSEAYYEKMVYKLLPGANKMLPKVFFAKSNIGFFQPSQKILDIKNSESFKKGDNFNLKDCHELIDFYKESISKHEDWSKFNFHFSETSSYQDISEFFREVEAQGYKITFNQVSKDYIHSLVEYGKLYLFQIYSKDFSEKKKSNGKPNLHTIYFKALFDEENLKDVVVKLNGEAEVFYRKKSINYDPEIREKGHHYEELKDKFTYPIIKDKRYAEDKFHFHFPITLNFKPKERSNFNLEVRKFLKASKDVNIIGIDRGERHLLYLVMINQEGKILKQLSLNTIQNEKQAVNYKEILQKREIARNQARKSWRTVENIKELKEGYLSQVVHKISKMMVEHKAIVVLEDLNLGFKRGRQKVERQVYQKFEKMLIDKLNFLVLKDRKNNEPGGILKAYQLTDKFVSFENIGKQTGFLFYVPAWNTSKIDPKTGFVNFLHLKYENVQQAKDLIGKFDSIRYNKQKDWFEFQVTTDKFFTKENLPESRTWTICSTPTTRYYTEKTTNSSIVTNEINVNEKLKELLSEFHFEDGKELKEKILQKDTKDFFSKLIFYLRVLTSLRQNNGKIGDQEKDFILSPVADSKGNFFNSLEAKDDEPNDADANGAYHIALKGLMNLQVLKQTQEENLDKPNWKIKNTDWLHFVWNRQN

SEQ ID NO: 61848 - protein, 427 aa, Unknown
  Microbial source - Accession No. Ga0308414_1007395
MNQRILTKRETQQRHKQMICKSYELKIDKSHLSKELANHLRQLFLEAKWFTNYAIANGIFEVDYKIKTVQIKVKDTFEERQIKHLSSQMKQAIIDKLKQDVKNLSILKNNGHKVGKIKFKRFVKTIPLKQFGVTYAICDKNHVRIQGIGKKVRVRGIKQIPTGAEFSNAYLIQDHGDYYLRGITYQNPENTVPKENSKNNAVGIDFGLRNQITLSNGISIQYRIPVITKKLRRLYKKFTRTQKGSNNRLKLNFKIQKQFAKSNNIKKDIKNKIVHCIRENFSIVCFQNDDIRQWQRIWGSKILDTAIGKFKDILKKRIPISIAVDKTFPSTYLCSHCGTINEISLAEEIYKCPVCGFTMHRDLKAARDIFSEGLKQLLMEHREAALLYQGRYACGEETSTRMLEYLNSIPYIRASFLYETGSLTASA

SEQ ID NO: 61849 - protein, 1024 aa, Unknown
  Microbial source - Accession No. Ga0308414_1018540
MDKQVAATQRAYTLRLQGADPRDQSWREALWQTHEAVNKGARAFGDWLLTLRGGLDHTLADAKVKGRKGKPARDPTDEERRDRRILLALSWLSVESAPKDGDTHKPFVTATGQDSQAIREEKVLCALRGILEKRGVRGADLEGWIKDCTPSLSAAIRDDAVWVNRSEAFDKAVDSIGSSLTRDEVWDMLERFFGSRQAYLAPAEGAEDESAEAEQEDKAKDLVQKAGQWLSSRFGTGKGADFSRMAAVYEKIADWAGKARAGMTGDAAVAGLAAALSEFSPASNDLQGVLRLISGPGYKSATRNLLNKLRARPSVAQEDLENLRDSACDDAEKCKAKTGSKGQRAYADAILKEVESVCGFTYLQEGGPARHSEFAVMLDHAARRVSLAHTWIKRAEAERRRFEEDARRMDKLPARVKQWLDAFCFERSEASGAMEPYRIRRRAVDGWKELVAAWSNADCKTAEDRIAAARALQDDPEIEKFGDIQLFEALAHDEALCVWHKDGDLAKSPDPQPLIDYVLATDAEFKKRQFKVPAYRHPDALLHPVFCDFGNSRWDISFDVHEAVKTGGRNRKNMMPPQDPHALSMTLWTGSTVEPQRLRWQSKRLARDLALKGRQGSNAPEVTRADRLGRAAAGVPERATVSIAGVFEQEDWNGRLQAPRAQLDAIAARVARHGWDDKARQMRDHLRWLITFSAKLQPSGPWLDYAAAFPDDAPAKSFVSRKGGYAVRHQDNDAREGHAKLVLSRLPGLRVLSVDLGHRYAAACAVWETLSAEQLKAACRAAGQEPPKDSDLYLHLKKKVKKQKKGREVEVEETTIYRRIGADTLPDGKPHPAPWARLDRQFLIKLQGEDTEARKASPAELQAVQRVEKEVGRVPPDQRALRVDDLMSETVRTVRLALQRHGRRARIAFNLTAGTKLLPGGREEVLTAEERVRLLADTLADWYDLFTGNGWSDQWARQQWETHITPLLKGAALPQMPHDAEDIAKSLAGNESLRRQLHCLWATRWRDYDVTLQKCLRRLRDWIL

SEQ ID NO: 61850 - protein, 683 aa, Unknown
  Microbial source - Accession No. Ga0308415_1006042
MLTRARTRVKKITKTILKLELKGDPNSMKFLDNLFNEYEQLVRIADTFIYHLYPYYANINEQEKFEGLNKLIRSIERKAIIKRRKDKKRETDDDFVYQQLPYLFAWLEGKISKESRYIYSHSDLLKTLLYTFIKYAKQYYGIDVKYVLLEKQGGLADLMHSNAENAYKHRSIPNMRRRLINVIPIRVSKRPLPENRRNKDKRNDDKPYERDTAFIFENGKIMFRIGRGKHKVVFKIATRFNDDERLSMFIKAIKGNDGLTIGDPCYLVRKDTDNGYRYYIMVSISKNVDVKALYEAIKNKSKIRIVGIDSNISKYITTMFCIEVDKENKTYKLVNAKGINSKDYINAVKKYEEDKRKLQQGRMKGKKQKKKKDSRYKEKEDYTIRNRCGDSKRIDIRRQLIGYICNQILEFANENYADIIVIEDLKGLNKELKTLRIIKKELGKLYNDVNTKGNNAIDDKINESKKYKNKIRKPLLGILNKIKEYSNAKDKVKVAKYILKQRQIIERRIFLLSMMAYYQFKQELDVEALWNGKLLYIINPKYTSQQCLRCGHTNKLNRITQRQFKCIKCNFEMNADFNASANIALRFATKVLKLELNLKQVEQGESSSMMTITKTNATTPLHASINAGSKLGVVADTLSSVASILQGCDEGRSPYLGGQTDEPCSVKSIATLDEFLEKKGNGG

SEQ ID NO: 61851 - protein, 1229 aa, Unknown
  Microbial source - Accession No. Ga0308419_1006240
IRKDAVWVNRSKAFDNAVKSIPYFSREEIWDLLHRFFVSQKKYLAPLDSPTEDKPDTTKKNSSKRLIKSARNWLSNRFGTGKGADFERSAAVYEAISRWASEAKPNKTNVLIDDLAKALQKFGVKTRDIKGISNVLKKSGRKSKTRSLLLQLSAKPNIEDKDLQRLKDTAEKDSKKERSKIGVKGHRDYASEILKAVEAACGFTYLQEGDRAKHREFAVMLDHAARRVSSLHTWIKQAEAERRRFEIDTKKKDQLPASVKQWLDTYCQKRSEETGAVEPYRIRRGAIEGWKEIVEAWSKPAITTSEERIQEARRLQDNPEIDKFGDVKLFEDLAREDALPVWHANGDPDKPPDPQLLIDYVEASEAEFKKRAYKVPAYCHPDPFLHPVFCDYGCSRWNISFTIHKEKAPDDPHGLSLDVWDGRAIRSVALRWQSKRFVRDLALNPKRSSDKPKVTRADRFGRALAECPSSDEVCIRGLFEDEDWNGRLQAPRPELTALAKHVAKYGWDEKANKLRNRLNWFITFSAKLRPSGPWEEYTKYAGGKHASPNKRGTMAKLRLSRLPELRVLSVDLGHRYAAACAVWETLSKAAFEQEIRERQILRGGTGPNDLFCHTRHVTDGQAKVTIYRRIGADTLPDGTLHPAPWARLDRQFLIKLPGEEREARKASPTELAQVEKLEKGLGRKTPDNRVKRIDDLMSDTLRTVRLALQRHNRRAQIAFKLTTTKRHLPGGRVESLGEQDRVTLLCETLKMWHSLFMGDDWTDDWAKTLWDEHIVPLLPPFDNQKADDLKWLKPAAEELASNPTKTQELHILWASRWQEDEQLWKERLRWLRHWILPRGIQTSAQKASIRHVGGLSLTRLATIKTLYQVLKAYHMRPEPDNPRKNIPAEGDEALQNFGQKILDDLEHMREQRVKQLASRIVEAALGLGRMKRATNKRDPKRPRERVDQSCHAVVIEDLTHYRPEERQTRRENRQLMNWSANRVKKYLGEGCELHGLHLIKVPASYTSRQDSRTGAPGIRCQEVPLIDFLKEPFWCKKVKCAKQRLSVGKANACDRYLCQLYERWENTPVTKAQTAIRLQIPLKGGELFVSADQNSPASKGIQADLNAAANIGLRAITDPDWSGAWWYVPCEANTFKPVKNKVAGSAAIDPNVPLKKDSPNSEKPASGQKHLVQRSRASKSIINLWCDISSKSISERDQWQESVPYWEDVAVRVIKILQASLVCSTTNSQ

SEQ ID NO: 61852 - protein, 488 aa, Unknown
  Microbial source - Accession No. Ga0308419_1011938
LQKAFKNYHLLYDRLLKVIYNELSSFYSAIAYSTKNGEARCSDKKAVQYINSQYRNVLNSFVLSSGLKESLCKDLADNLISYKELLAQRPNTSYPSLQKLKERVKERTLEELYESLKACIDTETYNHLRDAIARQSKENAKLKPLSFIRCDTTHQNMTFLYSPDRKKYYALLYVLPSSKKKLVIIKEDELYDVRTGQLFSRPKGTTTGLIFPIETGQRIVERYLNEKSQPKEGKLVYDSKNNEYYLHLAFEFKPEKIPTETIIGIDRGIEAICAYSVINMNYNLLESGLYEGKTLKELLKSEEKRMAEMQRRGVNYRFKVRRNWANRIIHEATNMIADIASKYKSQVYVEDLQGITDRTKARRKSSFNKMLNRSQFQKILMTLDYKLEGKGLPRAKKVHPAYTSMTCVQCGLIKPENRPKFDENGNPIQDKFKCVGCGYEDNADKNASRAIALKGIWTYIKKEDKIRQEIESFQSFLNKKLNKKVIAL

SEQ ID NO: 61853 - protein, 1476 aa, Unknown
  Microbial source - Accession No. Ga031036_000087
MAKQVAVTQRAYTLRLRGVDTQDQSWREALWLTHEMVNKGAKVFGDWLLTLRGGLDHTLADTKGKDGKEKHGCNPTDEERKARRILLALSWLSVESRLGAPEKFIIASGQDAAEERNGKVVAALEEILNSRGVEPNEINAWKINCSASLSAAIRDDAVWVNRSKAFDDAVKSIGCPLPRDKAWDMLGRFFESEDAYLAPLEGSEDESSDTEQEDKAKDLVKKAGEWLSNRFGKGKGADFSRMADVYGKIAAWAGNAQAGTTGNNAINELATALSEFTPASNDLQGVLGLISGPGYKSKTRNLLTQLAQTPVVTQDNLKDLNKRAAADTKKCKEKIGSKGQQPYANAILKEVESVCGFTYLQNGGTARHCEFAVMLDHAARRVSLVHTWIKRAEAERRRFEKDLQMLGQVPSAVKEWLDKYCEERSNSSGALEPYRIRRRAVDGWEKVVAAWSKTGCKTPEDRITAARVLQDDPAIDKFGDIQLFEALAEDDAVCVWHKDGDPNREPDPQPLIDYVRATEANFKKQQFKVPAYRHPDAFLHPVFCDFGKSRWDIEFAIHEARKVKATKSALRRKNRQCFDSSRELFMTLWTGNEMKRVPMGWQSKRLARDLALGQNTPNDGAPEVPRADRLGRAASNVTKSNEVKIAGLFEEAEWNGRLQAPRRQLEAIARRVDKHQWDAKAKKMRDQLHWLITFSPKLRPTGPWFEYAATFPDNALAKPSVSRKGTFFVKYRDNERPRKGGLILSRLPGLRLLSVDLGHRYAAACAVWETLSKEKFEGEIKGRKVRYSDSETGGLFCHTEHGNNAVTIYRRIGADMLPDGTPHPAPWARLDRQFLIKLQGEEEETRAASNQEIWAVHQLEAELGRTSPIIDRLVKAGWGQSGQQRTRLDVLCKLGWKPISEDRVSDGTDEGEYEVRKPSLSVDELMFSAVRTMRLALKRHGDRARIAFAMTAEYKPMPGDRKYYFTEAKDLSTNDDQVAREHKQIEFIQDALVLWHGLFSSRGWQDDAARKLWDDHVAKLSGYNAPEEIREDASGVERKKKQKENREKLYSVAKALAGDATLRKALHDAWKTRWKEDDERWKRQIRWFKDWILPRGKASNDPAIRKVGGLSLTRLATLTEFRRKVQVGFFTRLHPDGTKAETKEHLGQSVLDTLEHLREQRVKQLASRIAEAALGIGSENRKKHWDGRKRARERIKDPRFIPCHAIVIENLTYYRPEETRTRRENRQLMSWSSSKVKKYLAEACQLHGLHLREVSAGYTSRQDSRTGAPGIRCQDVSIKEFMQLPFWRKEVARAEKKRAEGKGDARECFLCELNAQWKDKSKAAWGEAGIVRIPLKGGEIFVSADKNSPAAKGLQADLNAAANIGLKALADPDWPGKWWFVPCNSTTFEPLKDKVGGFAAIRLNESLKKAPASWEGEETKKKRSRDVVNLWRDVSSQPISASDDWREFTPYWNGVQTRVVNILRQSAGPIMNHGER

SEQ ID NO: 61854 - protein, 457 aa, Unknown
  Microbial source - Accession No. Ga031038_009337
MAKRKRDKNAVVKTLKLELVDVLNYEPPPKKDGEEYTEKEKKRMFRKELRNLQKRIAQTSNYIMREYFLWELKRIEASKNGIILNEKEELGTTLQNKGYRIATETLKGLNTRNISALTSWLWENWRKYKKKVFNGSMSLPSYGLKQPIHIIKENYKIMPYKNNNEYIVEITFLSPSEGRNRTLKFVTVRQDKYRQNIINKILSGEYRQGSAQLILENNPNKNLSAQKIFFHFNYEFVPQVKEELSDKILGLDLGLKNVVVMQVYDPQQGKFEDLDENECMIDGTELVIYKNKIEALRKKANKATKWKGQGNTGHGRKKRTKNALNIGHKIKNSKSTYNYKLAKYIIDFALKYQCKYIKMEKLTRHGFSDTLLQNWAFNDLQNKIKNKAKENGIEVLFVEPQYTSQQCSKCGYIDKENRETRDNFKCKKCGFEIDADINAARNIALSEKIIKEDDDDE

SEQ ID NO: 61855 - protein, 457 aa, Unknown
  Microbial source - Accession No. Ga031046_00181
MAKRKKEKRTIIKTLKLELVDVLNYQPPISTDEKEYTKKEKERMLKKELRDLQKRIAQTSNYIMREYFLWELRKNAASKNGIVLNEKEELGTTLQNKGYRIAAETLKGLNTSNISALTSWLWENWKKARKRVLNGSISLPSYGNKQPIHINGKNYKIIAYKNNNEYIIEITFLSPSEKRNRTLKFVTAKQDKYHQDIMNKILNGEYRQGSAQLILEDNPNKNLSAQKIFFHFNYEFIPKQKEEISDRILGIDLGLKNVIAMQVYDPQHQQFISLDNNECVIDGLELVIYRNKIEALRNKISKATKWKGKGNVGHGYKKRNKNVLNIRKKISNFRKTYNYKLAKYIIDFALKYQCKYIKMEKLTRHGFSDTLLQNWTFNDLQNKIKNKAKENGIEVLFVEPQYTSQQCSKCGYIDKENRETRDNFKCKKCGFEIDADINAARNIALSEKIIKEDDDDE

SEQ ID NO: 61856 - protein, 672 aa, Unknown
  Microbial source - Accession No. Ga0310828_1006812
KHGFSYYHKGINYELKGTLGGARIQFDRDHLLRRQGVKAGNVGRIFLNVTLNIEPMQPFSRSGNLQTSVGKALKVYVDGYPKVVNFKPKELTEHIKESEKNTLTLGVESLPTGLRVMSVDLGQRQAAAISIFEVVSEKPDDNKLFYPVKDTDLFAVHRTSFNIKLPGEKRTERRMLEQQKRDQAIRDLSRKLKFLKNVLNMQKLEKTDEREKRVNRWIKDREREEENPVYVQEFEMIRKVLYSPHSVWVDQLKSIHRKLEEQLGKEISKWRQSISQGRQGVYGISLRNIEDIEKTRRLLFRWSMRPDNPGEVKQLQPGERFAIDQQNHLNHLKDDRIKKLANQIVMTALGYRYDGKRKKWIAKHPACQLVLFEDLSRYAFYDERSRLENRNLMRWSRREIPKQVAQIGGLYGLLVGEVGAQYSSRFHAKSGAPGIRCRVVKEHELYITEGDQKVRNQKFLDSLVENNIIEPDDARRLEPGDLIRDQGGDKFATLDERGELVITHADINAAQNLQKRFWTRTHGLYRISCESREIKDAVVLVPSDKDQKEKMENLFGIGYLQPFKQENDVYKWVKGEKIKGKKTSSQSDDKELVSEILQEASVMADELKGNRKTLFRDPSGYVFPKDRWYTGGRYFGTLEHLLKRKLAERRLSDGGSFKRGLSNGTDSDSNVE

SEQ ID NO: 61857 - protein, 1215 aa, Unknown
  Microbial source - Accession No. Ga0311022_13670299
VLLVYTGGQGLPLHAGNRKLCFEKFHNQEIASLAAMSFKGAVLHVSSENRKEMDMTQQNRPSVTQRAYTLRLYGANSEDASWRKALWLTHEAVNNGAKTFGDWLLTLRGGLDHTLADAKVKGAKGKPDRDPSIEERKKRRILLALSWLSVESKRGAPAAYIIATGREITENRNSKVVAAFEEILKSRGLTDTEIAEWRSDCTASLSATIRDDAVWVNRSKAFDDAAKSVGRSLTREQLWDMLDPFFGSRDAYLAPTKSSEDDSLEEEQGEKAKDLVQKAGKWLSSRFGTGEGADFSRIADVYEKITAWADAFQVGKTTTGDEAIKNLAAALSEFKPVSNDLTGVLRLISGPGYKSATRNHLNSLFGKKRINQEDIQILKTKAANDAQQCRQNTGSKGYRPYANAILKDVEDACGFTYRTDKDNKDVSVSDYSKFEDGYRWGPARHSEFAVMLDHAARRVSLAHTWIKRAEVERRRFEDDALKREQVPENVKKWLDDFCWKRSEASGALESYRIRRRAVDGWKNIVGAWSKAECRTMEDRITAARALQDDPDIEKFGDIQLFEALAEDDAVCVWYKDGDPAKEPEPQNLIDYALAAEADYKKRQFKVPAYRHPDALLHPVFCDFGESRWDISFSVHQQERNKSKLNNKKMITQGSPLRGLSLTLLTNIGIKPVLLCWQSKRLARDLALVSNADKGHVVNVSRADRLGRAASAVTENDTVAIESIFEEKKWNGRLQAPRRQLEAIAAVQNNSRFSAEERARRIQRMRERIRWVVTFSARLQPQGPWCEYAEKHRFKPDPRYWPHAEINKNRKGYARLILSRLPGLRVLSVDLGHRYAAACVVWEAVDAAHIKEACRAAGRESPNESDLYLHLKTKGQDGKERITIYRRIGADALPGNTPHPASWARLDRQFLIKLQGEEEGAREASNEEIWAVHRLESGLGRVAPLIDKLIAAGWGGTDKQKARLEALKQLGWSDRTAAASAGAGAEADEESGGIVPSLAVDELMSSAVRTMRLGLKRHGDRARIAFYLVTEEKTMPGGVKNKLDEQGKIDLITDALILWHDLFSSRGWCDDAAKKLWDDYIAKLSVYRALEEGDKDDSGSERRKQKDENRRKLYNVAEALLQDTDLQQRLHNAWKKRWEEDDEWWKRQLRWFRDWLLPRGKHTRAPGIRKAGGLSLIRIATLTEFRRKVQVGFFTRLRPDGTREEIKEQFGQSTLD

SEQ ID NO: 61858 - protein, 347 aa, Unknown
  Microbial source - Accession No. Ga0315269_0011078
METIKICVRGVISPRDMGLRKLMREYDVYKKVLIPRVKQTVRGIIKDKSLAVYSQQKWMIDKKLNEYLKNLSFHPMPFHNQSVYIESKDGKFWIHFRTKQGNVVCHLQVPMKYKSLIEKACGEDFADNPILGQVELIDDKKYGWINCHITLRLPKPEPYEPKGWIGVDIGWNKLATSILATKNPHLCFSSPIFHGKEFKTRIIQLRRLIKEYSRKGKSWKKWNFRLKNTIKYAVGVVAKEIVFKAKKFNAGISMEKLTFKSTTKGYLVPRYKLMIAIKTLSEREGVPFKLVSPQYTSITCPKCNYKDEKNRDKQWFKCQKCGYQTDADLVGAMNIALRALTASQMEG

SEQ ID NO: 61859 - protein, 371 aa, Unknown
  Microbial source - Accession No. Ga0315269_0014929
VARVETAYRTVILRLYPTPKQARMLKRAEAEVFKFLEVSRYQLMKLIYHKAGEAGVGVGRYSLSLLAQRFTGSLGNKAIIPLNTAYNARFIRENGVWFLEAQLLKGRGNRVKIPVAKTENKYYAAIGELGDLPLYVTREDDKWFAYVSIPVNAENNGRVIGVDFNLRKWVAAPAEGGPVLFFDASWYCREIDRLQRMRARLQSKGDLEGVQAACKGMVDAVTLAHGNFLARIQEKFGVCVIGMESVETLYKLTEKDNTMINNWLYSKTALRQFALRAMGKGFEVVEVDPRYTTRTCHRCGAPVKINGRRGRSITCPSCGLTNYHRDLNAARNIAKKAAEEWSKRVESRRRMEKLQPIAVAANGGGEEAAEK

SEQ ID NO: 61860 - protein, 439 aa, Unknown
  Microbial source - Accession No. Ga0315269_0030078
MENTIKMCVKAVIPPRDAGLRKLMHEYSVYKRILIPKVQRAVRQVVKDKSIAVYAQQKWMMDKKVNEYLKNLPFHPMPFHNQSFYIEDKDGKFWIHFKTKQGEAVCYLRVPARDHDLIEEACGNDYASNPILGQAELIEDRRFGWVKCHITLRLPKPEPYTPKGWVGVDIGWNKLATSILATTNPHIRFIKPAVHGKDFKTRIIQLKHLLKQYARRGNAWKKWDYRLKDSIKYAVGVVAKEIVAKAKKHKAGVAMEKLTFKSTTKGYLVPRYKLMMAVKTLCERSGVPFKLVSPKNTSLLCPKCENKQSRSWAEENGKDEKEQRKLFQTRIRKNREKARFRCIDCGYQADADIVGAMNIAQKALDSFPYEGENDVGFTPTSKADRGLPRKAGHVASPQAPMTDDPYKARRKPNKIENEVRNRLKWALNGHRTDLTQRLQ

SEQ ID NO: 61861 - protein, 796 aa, Unknown
  Microbial source - Accession No. Ga0315277_10001015
MATKSFEARVLCRDDPPDKKGEKYSAEQKKQFLWYTHQVFNESIRKVLPYVFKMKRGELGDEFQAIYYAISSSQDAVGKLEAITSLDWSSKKIGKSEPEKWKEILRYRELEKEFRQKLKDEEKNTKKFRKELQKKKKALANEIGQKDIWADAASIIQQKNNLLFDREKILPNLPSEFRRKIFEMCIQLIHGHQELVANWQDEHAEWLQEKDKFEEEHPDYMKVRPILEEFEKEAGKVKGSRIRWLKYLDYMSSHPELAGWRGGEAKVEPLTSAERAKFRKPREHFEAFFKKNPELSALDSIHKQYQEKFARTQTKRTPNPDGFKHRPTFTLPSANLHPAWYSFKGATDPTKGATYKLNFREDRRVDSFMNLKVLTDMEGEGRNPKGMITYDFEPDDRIRDFRYIGTTEKGKKAKGFVYYDKILEKERPAKIQGIKLVFRPPRSDGVPYLIFSCSIEDEKSKIKIWQDKESEEGPDEARKGKKAKKIYPPELVTLAIDFGQRHLGAITICKNNNGKPEQIKFIPAYPKRKQGKQTKPVSAWLAKVPGLTFNAIGMHEKEIRAGMHQRFQDPKSIRQAGEKEGRASKPRHIPETETSFAHLRDHIAGMKEDHYKKAANLIIKTALQNGAQVILLEDLKKYRPMLEKESRENRRRMQWAVRQTAEFLKKTAKPLGLLIYDRINPAYTSSMCSVCGNPGARISLPSKRNWEKYYAEYYGKERRMIAVVGGQFFCCPVCKKIINADINASQNMHKVFYNTFNWPPKMEKKEKKIFWESVREQAQNILDQKAEPKREEDISY

SEQ ID NO: 61862 - protein, 478 aa, Unknown
  Microbial source - Accession No. Ga0315280_10009663
MEDLRMAKKTENRHIKVLKLRILKPAGEMTWADLGEILREARYRVFRLANLGVSEAYLNYHLWRSKRASDFKIRTMGELNRELRETLRNEGKNEDQLNRFSKTGALPATVTDALSQYKLRAVTKKSKWKEVINGKSSLPTFRLDMAIPVRCDKKDQRRLEKTASNEVELDLMISARPYPRVVLATQEGSLGEGARAILEKLLENENQSKAGYCQRCFEIKQDTLSRKWFLFITYDFPATEVLSSKDRIVGVDLGVSCPVYVAINNGYARLGRRQFNPLMARLRALQNQTIRRRREIQRGGNEIISEERARSGHGRKRKLMPIEKLQGRIDRAYTTLNHQMSAAVIKFAKNNGSGVIQMENLDGLKEELTGTYLGERWRYAELQHFIGYKAKEAGIEVRKIDPKYTSRRCSECGYIYIEFNRAFRNTEHEKGKAAKFRCPVCNYEADADYNAARNIATLDIENIIKLQLEKQRVNPGDH

SEQ ID NO: 61863 - protein, 383 aa, Unknown
  Microbial source - Accession No. Ga0315280_10032046
MENTLKLCVKAVISPRDMGLRTLQKEYANYKKVLIPKVQKAVRQVAKDRSIKVYAQQKWMLDRKITEYVKNLPFHPMTFHNQSVWLERMEKGHFRIHFKTKQEEKEAVCYLQVPSKYRDQIEKTCGKDNPVLGQVELIEDRKYGWINVHITLRLPKPESYEPKGWVGVDVGWNKLATSILTTVNPHLHFANPTVHGKDFKTRIIQLKYLLKQYARKGRSWKKWDFRLKQSVKYAVGTVAKEIVGKAEKHKAGISMENLTFQSQTKRWLIPRYKLMIAIKTLCERKGIPFKLVPPRNTSITCPKCGFADSGNRNGERFNCRKCGYKADADISAAMNIAAIAIGFMPLAKEVRLHAKTSGDVATPLSTDEPMTSIKAGANPTESK

SEQ ID NO: 61864 - protein, 446 aa, Unknown
  Microbial source - Accession No. Ga031528_10053614
METIKFCVKGIISPKDKALQILQKELKNYKNALIPKIQNAVRKVVKDRVFQVYAQQKWMLDKKITGYIKNLPFHPMTFHNQSVRLEKTEEGQFYIHFKTRQEEKEAVCHLQIPMKYRSQVEKACGEDNPVLGQVELIEDNKYGWINVHITLRLPKPEPYEPKGWIGVDVGFCKLATSILAVPYVEARSIGHISSPLKGVTESPSSEALSSIAFNQQHKADGNTPNQGYKNRLNTIIIKFSNPTIHGKDYKTRIIQLKYLLKDYARKGKGWKKWNFRLKQTVKYAVGTVAKEIIAKAEKHKAGVAMENLTFQSQTKRWLIPRYKLMVAIKTYCERKGIPFKTVPPRNTSITCPKCRYVDAENRDGERFTCRRCGYQADADISAAMNIAHLAIYEEVEHLNSRKSAIAIGFTPMVKEARLHAETSGDVATPLSTNEPMTFIRTGANPV

SEQ ID NO: 61865 - protein, 389 aa, Unknown
  Microbial source - Accession No. Ga0315282_10053614
VETIKFCVKAVISPKDKALQILQKELKNYKKMLIPKVQKAVRKVAKDRSINVYAQQKWMLDKKLTEYLKNLPFHPMTFHNQSVWLERTEKGYFLIHFKTKQEEKEAVCHLQVPSKYHSQIEKACGKDNPILGQVELIEDNKYGWINVHITLRLPKPEPYTPKGWVGVDVGWNKLAASILVTANPHLHFSNPTVHGKDFKTRIIQLKYLLKQYARKGRSWKKWDFRLKQTVKYAVGTVAKEITVKAEKHKAGVALENLTFQSQTKRWLIPRYKLMVAVKTLCERKGIPFKLVPPRNTSITCPKCGYIDAKNRNGERFNCKKCGYQADADITAAENIAAIAIGFMPVVKEVRLHAEASGDVATPLNTDETDDLIKGRCKPSKIENEVTVKG

SEQ ID NO: 61866 - protein, 488 aa, Unknown
  Microbial source - Accession No. Ga0315285_10079970
VSVLLTAKLKVHNPSARKRQILDRALEEYTRAYAELLQWAKDNLSTIEEKGRYNGRFTETAIRSVFPNPSAFNHYYLHSSARDALWVDVAGTLCSYFRLREQNPSTAFPSCRDPSPETYPNALDDFAAVLDDEQQEKDCRARLLKVARGSVMPMYFSRPDAVPRNRNFSLLHDPQRQRYYALLYLEPGANNSDGCLRGKGNLVRVGWPQGKNAGDPRPAFRARAPCAVLLPLALGDWHVETFLNTSLRGDANVRSAFLSRRERGGREPEYYVHITFEFSPERVQTETALGVDRGLANLIALTVTDEAGKILHQELHPGRDLIDYQKYVYTVYRSRQKRGRSVAGQAMVARVNEEVCHRLANVIVETAVEHKSQVVMEDLKWFKERRRDFGQLKRAPLQRIQQILEYKLPMRGLPRPWYVGSAYTSRECPLCGYGFQVKGRGINRPSQDRFKCERCGYQTHADLNGSHNVARRWLQRKAERARPSTLTA

SEQ ID NO: 61867 - protein, 473 aa, Unknown
  Microbial source - Accession No. Ga0315288_10142264
MTEKEIAKRHVKVLKLHILKPADGMTWPELGKILKEARYRVFRLANLAVSEYYLGFHLWRAKKTEQFSTRTIGELNRELREMLKEGKSAEELDLFSKTGALPDYVAGALSQYKLRAVTSKSKWKEVINGKAALPTFRLDMSIPVRCDKPNQRRLERAANDDVQVALMVCSKPYPKVVIATGEPSLGGGPREVLKRLLENKSQSKDGYCQRCFEIKQDRLSGKWFLFVTYDFPVTQIAVSKERVVGVDLGVSCPIYVAINNGHARLGYKQFSSLMARLRALQIQTITRRREIQRGGKTIVSDDRARSGHGRRRKLLPIEKLEGRIDRAYTTINHQLSAAVIKFAKNNGSGVIQIEDLKGLGQELSGTYLGERWRYAELERFIEYKAKEAGVEVRRVQPQYTSRRCSECGNINMEFTYEFRKAEKEKGNRLKFKCPKCNYEADPDYNAARNIATIDIESIIRLQLDKQDHQDVDL

SEQ ID NO: 61868 - protein, 636 aa, Unknown
  Microbial Source - Accession No. Ga0315298_1000517
MDGLRGQRTRLRVGSWRRSWDLRDVPDERKRTVHRTAHRLTIRAETAIRDDHACTKASYLRPTMGMKRREGESMFGNPSEPSCVYRYGAYAPTTNIEIVHEQMRIGSRYRNKLCEIELARRAERDAFLQEASGEVNAAEKALADICAEIDKIKTEIAEYRKRARKRKLPPELSARRKELFAARKAARQRRNAAKKAAYKSSEFKEGLHKIDVAAIEKIKQARAESGLYWGTYSHVEQSMKGTQKGPPPKFKSYRNGEGTIAVQVQHGLTVREAESCKDTRIRIEGTGRKRILHIRVGSNGRKPIWATVPFVYHRPLPEDALIKWVRVTSRRVACHFHWYVLFTVSRPSGWKKADLAPDGVVAMDIGWRLFRDRFRVAYWVGSDGQEGEICLPLEYLDRRDKKNDLRKIRDEKFNAIRDKLADWIEAKTDALPQWLKEDTTSLRQWKSQARLAGLVLRWSRQRFTGDEEIFPELEDWRSDDRHLYEWEVNQERKAIAWRNEQYRIIAAELSRRYRKAVIEDINLHELSDSEKATDSANNATRDGKVGDGKQAWRRMVASVGRLKQFIKERFDSTVEVKCEWTTQDCAYCGERMNVDAAHNVVIKCPSCGVEIDQDRNAALNLLKRAGVPLESILVCS

SEQ ID NO: 61869 - protein, 583 aa, Unknown
  Microbial source - Accession No. Ga0315298_1001941
MQEQIKTFFCEKCNKEKKIPRNLLGKADAVEKARERHYHKEHTLILGIKFKIYPEKKDLEKINEYFDEYAKAVNFAARLIDKLKGQFLFMGKRNKEDEERKYIFPIARCDFCGEEKEISYQNKRGKKICFSCYQNEFGENGIRKKLYATKGRKVNASYNIKNATNKLCATHYNYVIRDAFQLLDALKKQREKRISRLIRDKGKLKKFEEMLEQEDKRYELPKKERQREPRFIHISLKDRAQEFEGRGYTIKRIKEKIKVLRRNIEREEKSLNKKTPIEFSGKRITLSSSLKFNIEKSLVRIPLTKELTKDYKFGGMNVANEHGRKFFEEKLKLIKENKPKYSYLIRKQINKDPDKPFYDYYLQYTVEFLPEVKQNYKRVIGIDRGIDHLACLVLLENGKEKPSFVKFFSGKDILKLRNQRRKQLSFLIGVHNKKRKQKKIRPIEPKIHQILHTISKQIVMLSKQKEAAISLEQLEKPKKGKYKQSKSTKYKLGQFVFKALSDYIEYKAKKEGIRVIYVPPEMTSQICSHCAIKGKVHVDTKRPYKNSYKLFKCNKDGCGVELNADYNAAFNIAQKGLKILNSK

SEQ ID NO: 61870 - protein, 1470 aa, Unknown
  Microbial source - Accession No. Ga0315298_1005332
MPKQNKPPVTQRAYTLRLRGTDLNDQSWRDALWKTHEAINKGAKAFGDRLLTLRGGLDHSLVDTKVKGGKGNPDRDPTDEERKTRRILLALSWLSVESKLGAPENFIVASGEESAQDRNNKVIAALEEILKSRGVAENEIDQWKKDCSASLSAAIREDAVWVNRSKAFDCICGNEDKKKAREDAQTLLWFLLTDDYLAIPKKPVKASETTVLDDKKEETGDDSSGELIVKSGKGAGKRTRHPFSHIFGRETTKGFGNPLRTFNLRNFWRQYLKPKIEAAGIPLSDPNAKAKKKDPPSPTELHREMFSQAAARLAQIWTKQKQQELERVQRAAADDELKKLENDPAYNTVLKRLEMFCRERGQATGSLEEYRINPRAIEGWDRVVTAWENISETDNDRATEKRIEKAKDLKKDNPDKKFGDINLFIHLAEPEYEPVWRHNGQADPSILKTYVKGWKARTDAIRLKVAAFRHPDPYFHPVFCHFGVSRPPIKHNRLNKRSVDDTRIVQMLLWTECKAEYVQLLAISKRFDAEIGSAAESSRDASANVPEVARRSRLGVAAITKQGGGDTFCVANVFDQQEVRPRKGEDKDGTQEEGCNNESQDRKKKEPTWNGTLQADRLKLEAIGRLQSSEPQKALLAKQHLRWWLIVSLELQPTGPWYDYITVLSDKSPFLRTARKDEDKGEKRKQGAKYISWSGWPHDEVNKPLRKNKNGTGLEADPTSHRQSMAALILSRLPGLRVLSVDLGHRYAAACAVWEALSAEAFKKDIDGKKILRGGTDEKDLYCHTEHEADGKKHVTIYRRIGADKLPDGTPHPAPWARLDRQFLIKLQGEEEGVRQASNEEIWQVHQLEAALGRSKPLINRLISSGWGITKNQQSRIEALKKLGWCPPEQPESGDVSDADEEEIAYKPPLSVDELMSSAVRTMRLALKRHGDRARIAHYLITDEKTKPGGVKEKLDANGRTEMLQDALVLWHDLFSSRSWRDDAAKQLWDEHIIKLTGDKLPEEIGEDASESERGKKKKENREKLHDAAKALAQDESLRKTLHDLWKTRWEEDDRQWKKHLRWFSDWVLPRGKAAEDPAIRKVGGLSLTRLATLTEFRRKVQVGFFTRLHPDGTRAETKEQFGQSTLDALERMREQRVKQLASRIAEAALGIGSQDKRHWEGGNRPRRRINDPRFAPCHAVVIEDLTHYRPEETRTRRENRQLMTWSSSKVKKYLAEACQLYGLHFREIFAGYTSVQDSRTGAPGIRCQDVPVKEFMRSPFWRKQVKQAETKLLENKGDARERFLCSLNAMWKDKAVTDWERAGVVRLPLKGGEVFVSADPLSPAARGLQADLNAAANIGLRALTDSDWPGKWWYVPCESSSLRPVKEKVEGSAAVNPTQALPQSAQKQNDGAGAKKKRKGSGTGKPKEVVNLWRDVSSSPLDDPNAGEWKEYTAYQNEVQWRVVRILEEELKGRFQRLYEGAKEDGIPF

SEQ ID NO: 61871 - protein, 1362 aa, Unknown
  Microbial source - Accession No. Ga0315298_1007399
MTNNIKNQKSIWSEFIKQYALNKTLRFELKPVGRTEDFLKQNKVFEKDKTIDDSYNQAKFYFDKLHQKFINEALFSESVKSINLKDFAEKFLGLKSEIQKLKSEKKQEEANKKEKEVNDIRNDYYKKIKSLLDKKAEEWKKKYKDGGLKFRKTDLKQKGTDFLMKSGILGILKYEFPKEKEEEFKNKDWPSLFVEDKANPGNKVYIFDSFNATYLLKFQETRKNLYKDDGTSTAVATRVISNFEKFLNNRKIFEDKYINHWKEVGITEEEKKIFEIDYYYNCFIQEGINKYNDLIGQINQKTKQYRDKNKIEKSELPLFKVLDKQLLGEVIKERELITKTENETEEDVFVKRFKEFVDRNKQIIPRAENLMNDLINEKFESDYYGIYLKRAAINTIANRWFKNTTEFLLKLPQASKSKENKESPKVKPFISLLDIKNALDDFEKEKESLGTIFKDKYYKTKESDEAPLNNDSQESYWKQFLKIWNYEFNQLFEDKFKEKGIKVFLGYTEALKKQVENLKSFSRKKEEIVLVKNYCDAALRIYQMMKYFALEAKKQDDIPLDYATEFYNRFDEYYKDFKFIRYYDAIRNFVTKKPSNEDKIKLNFESGSLLTGFDKNKESEKLGVILRNRNSDKYFLGIINKEHNKIFDSKNESKFIGDDNKDLYEKMELKLFPDPKRMIPKIAFADKNKKDFGWTQEIQKIKKDFENFQKNKKDNKDLKFDKNKLSKLIEYYQNCLEKGNYKKEFDFEWKKPEEYQSMSEFNQDIEKKNYKIKFIPVKDSYIEEKVANGELYLFAISNKDFIWPDQKKNIHTLYFFNLFSDKNIQKPIFRLGANAEVFYRPASVKKELDKGRSKEGKEIIKYKRYTEDKIFLHLPIEINYGCPKVPNEEARKKAFAAKYNNKLIEFLSKNINKINIIGIDRGEKNLLYYTVINQKGEILAHKSLNEINGVNYLEKLIEREKKRQIDRQSWEPVVKIKDLKKGYLSYVVRKIADLVEKYNAIIVLEDLNFGFKQKRTKIERTIYQQFEKQLIDKLGYLVFKDDRGSESPGGVLSGYQLVAPFTNFKDLGKQTGIIFYTNAEYTSKTDPITGYRKNIYISNSASQKTIKENLINKLKSLGWDEKEKSYFFTYNQKDFGSPISKEWTLYSKVPRVRREKNNSNGYWDYQPIDLNEKFEDLFEKYGINKKSSDILSEIKELIKNNEEKLIQKQEFDGKSKKFYERFIYLFNLLLEARNTMSLKVKLDKRGNEIKLDEIDYGVDFFASPVKPFFTTAGIRFIGKQNEDKKIEKQIKEKFAEENFADFKGLFKDCSSDGFDSDGVGAYNIARKGIMILERVKQNPQKPDLYISKEDWDDFALKNAIIK

SEQ ID NO: 61872 - protein, 767 aa, Unknown
  Microbial source - Accession No. Ga0315298_1007594
MARTRYREERTLVRRLCRLPREEEERSEFNHKVLKLREQFKKFNLDASETCQWLMGIRPDGKRANERTKLFWDFFLEPEKFLKEEDKDKSDRCRRVVFDFVAGFEKDTALSEFSFSKELMDSIQAIKSMPRIPCAEKLFQRLVQLNPAHRQVLLKASSEWIFAHYQKAKDNWEFQHKHWEEEKKGWENRYPDLTDEIRKEFTEIFKQMDIREKRPRICPWERLKESKDNCLYAGEKIGKKNHAQLCKKYKDFLDDCKRNNVKKFFAENAEKYLSLKRNQPYLPKEIIIKEFLNKNPKAKWFTDAWDKYLKAMGITEQTILSRGSLPHCVEFGDDKECQFNQHTEKCRQYKALLDAKPELQALEGLYRKWREKYLSGPSKPSFKYPSAKKLSMPKIFGAGFFEVDFNKSILKLRLDDMPEGKFLEFGFIPWPKDYKPQPNETEITSCQVNFIGTRPRVGFRFKTPHKKSRFTISQDEIDELRSRKYPRQEQDQKFLDEARKRLLESFPQDPKKELKILAVDLGEKTGGAVLFKGTDFQKYFPLKVVKMKKLLEIRPEDEKDKNDKISKEEKKELRKKGLGKWHIALHLEARREQAKAIAEKRQKEKEKAELRNFDLRKLTLHTRWMIRDWVRLNASQIIQLAEQNQVDLIVFESMRGFSVPGREEIGKEDKKLAFLAAGQIRRKVAEKAVERGMRIITVPYLESSKHCSICKKLQKDEKIWRKNKLDEHKFRCEKCKAEMNSEENAARVLARVFWGEITLPGQLPDHT

SEQ ID NO: 61873 - protein, 1380 aa, Unknown
  Microbial source - Accession No. Ga0315298_1015991
MPETPAYTTRAYTLRLAGATPEDHAWRGRLWQTHEAVNKGARVFGEWLLTMRGGLDHTLADQQDPQQRRDHRVALALSWLSVESPAEAVASDLIVSRGKDPHEDRSQALEIALREILQQRGLSDADIDSWLVDCRATLGARIRDDAVWVNRSKAFDAITEQPRRPQARVDCQVLLWHLFTHDYLTLPRASLRRRQEQQAQREGADQDPDEGQGEDKRSAVVRSGRGAGTRTRHLFSHIFGGSPTFGKDKHKEKEKERVLALRGHWLAYLQPLVEGAGIPLRDPSQPRRANDGAVPTELHREMLSKAAARLAQIHTKQKQQEIEREQRERADEALRRLEDDPAYKEALALLEAYCDDRRAEWGDYTIRPRALEGWRDVVAAWALCGSEEERVDEVKRLQDEDPDRKFGDPNLFCELAQEKYVPVWRHCGKEDPDLLTRFVKGNAARADAKRLRVAAYRHPDPCFNPVFCQFGISRPAIKFARLGQLRKSKEPGSERSTAVSLLLWDGKAARTTILQALGARLDREIGTVDQQQPLDRDPTLVTRRTRQGFAVAAQESASGEGSRVIGVFDEQDIEKRRPEHDQAAAGKVARKAPEWNGTLQADRRALAAIGRAADAREAARAREQLQWWLTVSIELRPQGPWPTYADKHGIELDRGREGIVTLPTKKADEWRGLAYPCWVDDNKGRHGRDRLVLARLPGLRVLSVDLGHRAAASCAIWETLTRPQVEEICRACGHDAPGEGDIYLHLKRKVLKQDKGGSAREAEATTIYRRLAADTLPDGSPHPAPWARLDRWFTIRLQGEEAQARFATRAEQAAVRDFEKWLGWQAGNRRRSQRIDELVAHAVDLARRGLRRHADHARIAWGLAAPKKQLPGGRRPDGEMSREERVAHLQGVLLRWHDIAFSTQWKDDWAQELWNATLPDYQKPEPIAENASAKEKKAARERNLETLRPAATALAEDSARRLALHEAWKSRWAQDDGAPAQVDRQASGCKQSQGTGWHAHLRWLHDWLLPRGNKSRKRTLRQVGGLSLMRLGTIRDFHRKVQKAFFTRLRPDGTKAEAPESFGQRTLDDLAAMRENRIKQLASRIVEAALGVGSENPLHREGRRRPRQRIADPRFAPCHAVVIEYLANYRPHQSRMRRENRQLMDWSTGRFKQYLAEACALNGLHLREVSAAYTSQQDSRTGAPGIRCEQVVLREFLQSPFWRKKVSSAAKRAGNPFTQLWRDLVNRARKSSPADAATTVLYLPREGGRLFVSASPCLCCQPSSQGLAPINADLNAAANVGLRALSDPDWPGTWWYSPYNLTQSQPCLDKAKGSAAISAGSPPAAPAQATTQEKVINLWRDVSAKPITPENGQPYSRYWNGVQERVVARLRPALGLHHEP

SEQ ID NO: 61874 - protein, 847 aa, Unknown
  Microbial source - Accession No. Ga0315903_10087816
EVRKKYTPTCLADYFHTHFKAQKKTDSEKDYTLTANVEAKHSAIKGILNIPYPNDKKLYQQQKDIDNIKLFLDSVMELLHFVKPLSLNKDSALEKDNSFYGQFEVLFEQLDMLTPLYNKVRNYATQKAYSTEKIKLNFDNSTLLKGWDINKETDNTSVILRKDDQYYIAIMPQDYKKAFQSIPKAIDGESTFEKMDYKQIALPMGVGAFVRKCYGTAMQYGWVCPDDCKNEEGKIIIRQDEIKGNLAALIDCYKDFFDKYEKEGFQYKEYNFKFKDSAAYENLNQFFLEVEQQGYKISFREVAETYINQLVEEGKLYLFKIHSKDFSAHSKGKPNLHTLYWKALFEPENIKDVVYKLLGQAELFYRKASITSDKIIVHRAHEAIDNKNPEKKKATSTFAYDLVKDRRYTVDKFQFHVPITLNFKATGNNYINQDVLTYLQRNPEVNIIGLDRGERHLIYLTLINQRGEILKQLSLNDIINTYKDAAGNTVDVKTPYHTLLDTREKQRAEARENWGAIETIKELKEGYISQVVHIIAKMMVEHNAIVVMEDLNFGFKRGRFKVEKQVYQKLEKMLIEKLNYLVFKDKAPSETGGLYHALQLANKFTSFKEMGKQSGFLFYVPAWNTSKIDPTTGFVNLFDTRYESIEKTKSFFDKFKSICFNPIKNYFEFAFDYTDFTTKADDTKTNWTVCTHGDRIRTYRNPDKVNQWDNKPIQLTQEFEDLLGKYNITYGAGACLKAQIAEQKDKEFFASLLHLFKLTLQMRNSITNSEVDYLISPVANERTGLFYDSRKKNEKLPKDADANGAYHIAKKGLWWLEQIHELEGQEWKKLDLDKSNKGWLAYVQQSK

SEQ ID NO: 61875 - protein, 1000 aa, Unknown
  Microbial source - Accession No. Ga0334883_1024988
AAIRDDAVWVDRSKAFDEAAKSIGCSLTREEVWDMLKGFFGSHEAYLNPAKGSDEESSDTGQEEKAKDLVQKAGQWLSSRFGTGKGADFSRMVGVYQKVADWAGACPGNNAGTDAIANLAAALSEFTPISNDLQGVLGLISGPGYKSATRNLLTQIDAKTTVTQADLTKLKDTAATDKEKCEPKIGSKGQRPYSNAILKDVESVCGFTYRVDKDGQPVSVAHYSKYDDDCSWGSARHSEFAVILDHAARRVSLAHTWIKRAEAERRKFEEDAQKVDQVPKAAKDWLDQFCLERSGMSGALEPYRIRRRAVGGWKEVVAAWSKNSCTSYDDRIGVARALQHDPEIDKFGDIQLLEALAENDAVCVWHKDGDAAKAPDPQPLIDYALAAEAEFKKRHFKVPAYRHPDALLHPIFCDFGNSRWDIRFEIHENVQTSSPHALLLTLWTGSGMNSVQLCWRSKRLAHDLALGQNAQNAGVSEVARADRLGRAASNATKSDKVKIAGLFEQETWNGRLQAPRQQLEAIAKRVEKHGWDENAKKMRDRLQWLVTFSARLQPQGPWCEFAKTNQLRIDPQYWPHADANKTRKGQARIILSRLSGLRVLSVDLGHRYAAACAVWEAVNAEQVEKACQVVGHEAPKASDLYLHLKSKAMKRKKGNQVEVEETIVYRRIGADILPDGMPHPAPWARLDRQFLIKLQGEEEGVREASNKEIWAVHQMEADLGRPVSLIDHLVASGWGGSDKQRARLEGLKQLGWNPAEKFESGGESDLGEASDAYRPSLSVDELMSSAVRTMRLALKRHGDRARIAFAMTAACKPMPGDRKYYFTEAKELSMNDDQVTRSNKHVEFIQDALVLWHGLTSSRGWRDDAAKQLWNDHITRLSGYKAPEEIGEDTSAAERKKKQKENREKLHDVAKVLAEDATLRKVLHDAWKKRWKEDDERWKKELRWFKDWILPRGKAVDDPAIRKVGGLSLLRLATLTEFRRKVQVGFFTRLQPDGIRAETK

SEQ ID NO: 61876 - protein, 1490 aa, Unknown
  Microbial source - Accession No. Ga0334884_1015165
MPQQNKPPVTQRAYTLRLRGAAPNGQSWRDALWQTHEAVNKGAKAFGDWLLTLRGGLDHTLADTKVKGGKGKPDRDPTDEERKARRILLALSWLSVESRLGAPESLIIASGKEPTKDRNDKVVAALEKILKARRVEQNEINAWKNDCLASLSAAIRDDAVWVDRSKAFDEAAKSIGCSLTREEVWDMLKGFFGSHEAYLNPAKGSDEESSDTGQEEKAKDLVQKAGQWLSSRFGTGKGADFSRMVGVYQKVADWAGACPGNNAGTDAIANLAAALSEFTPISNDLQGVLGLISGPGYKSATRNLLTQIDAKTTVTQADLTKLKDTAATDKEKCEPKIGSKGQRPYSNAILKDVESVCGFTYRVDKDGQPVSVAHYSKYDDDCSWGSARHSEFAVILDHAARRVSLAHTWIKRAEAERRKFEEDAQKVDQVPKAAKDWLDQFCLERSGMSGALEPYRIRRRAVGGWKEVVAAWSKNSCTSYDDRIGVARALQHDPEIDKFGDIQLLEALAENDAVCVWHKDGDAAKAPDPQPLIDYALAAEAEFKKRHFKVPAYRHPDALLHPIFCDFGNSRWDIRFEIHENVQTSSPHALLLTLWTGSGMNSVQLCWRSKRLAHDLALGQNAQNAGVSEVARADRLGRAASNATKSDKVKIAGLFEQETWNGRLQAPRQQLEAIAKRVEKHGWDENAKKMRDRLQWLVTFSARLQPQGPWCEFAKTNQLRIDPQYWPHADANKTRKGQARIILSRLSGLRVLSVDLGHRYAAACAVWEAVNAEQVEKACQVVGHEAPKASDLYLHLKSKAMKRKKGNQVEVEETIVYRRIGADILPDGMPHPAPWARLDRQFLIKLQGEEEGVREASNKEIWAVHQMEADLGRPVSLIDHLVASGWGGSDKQRARLEGLKQLGWNPAEKFESGGESDLGEASDAYRPSLSVDELMSSAVRTMRLALKRHGDRARIAFAMTAACKPMPGDRKYYFTEAKELSMNDDQVTRSNKHVEFIQDALVLWHGLTSSRGWRDDAAKQLWNDHITRLSGYKAPEEIGEDTSAAERKKKQKENREKLHDVAKVLAEDATLRKVLHDAWKKRWKEDDERWKKELRWFKDWILPRGKAVDDPAIRKVGGLSLLRLATLTEFRRKVQVGFFTRLQPDGIRAETKEQFGQSALDALEHLREQRVKQLASRIAEAALGIGRMRRPMGGKDPKRPNGRVDEPCHAIVIEDLSHYRPKETRTRRENRQLMTWSSSKVKKYLAEACQLYGLHLREVSAGYTSRQDSRTGAPGIRCQDVPIKEFMRSAFWRKQVAWAEKKRAEGKGDSRERFLCNLNAIWKDKTMADWEQAGVVRVPLSGGEIFVSADPVSPVVKGLQADLNAAANIGLRALTDPDWPGKWWYVPCEPGSFKPVKDKVDGSAAVKPEQALRQSAGVRSGGAGKSKEVINLWRDISSSPLECIECGEWKEYTAYQNEVQCQVIRVLGEQIKGHHKQSYGRVKEDGILFR

SEQ ID NO: 61877 - protein, 664 aa, Unknown
  Microbial source - Accession No. Ga0370516_000963
MLARTRVKKITKTMLKLELKGDPKSLEFLDNLFNEYERLVRIADSFVYYLYPYYANITEQEKLERLKELVQSLDEKAIRKNKRRKREPQEIEEQTITETETKHKYTHSNLLKTLLHRFIKYTKQYYGIDAKYAWLEKQGGLADIMHSNAESAYKHRSIPNMRRRLTNVMPITMSKSPLDENRKDKKNNGRYYKKDAEFIFGNGKIMFRIGRGKHKVTFKIATRFNDAERLGMLIHAIQGDNGFTIGDPCYLVRKETYNGYRYYIMVSISKNVDVKALYEASKNKSKIRIVGVDSNISKYIATMFCIEVDKENKEFKLINAKGINSKDYINAVKKYEEERRKLQQGRMKGKISKKKCSRYKEKEDYTIRNRCGDSKRIDIRRQLIGYICNQILEFTDENNADIIVIEDLKGLNKELKHLRIIKKELGKLYNDVNDKGNNAIDDKINEINKKYKNKIRRPLLEILNKIKEYSNAKDKVKVAKYILKQRQIIEKRIFLLSIMAYYQFKQELEVEALWNGKLLYTINPKYTSQQCLRCGHTNKLNRITQRQFKCIKCKFEMNADFNASANIALMFATKILKLNLKQEEQGESSSMMTVTSATTPLHASINAGSKLGVVADTLSSVASILQGCYEERSPCLGGQTEQPCSARRSIATLDEFLEKRGNGG

SEQ ID NO: 61878 - protein, 687 aa, Unknown
  Microbial source - Accession No. Ga0370516_004838
MLTITKARTRVKKITKTMLKLELKGDPNSLEFLDNLFNEYERLVRIADSFVYYLYPYYANITEQEKLERLKELVKSLDEKAIRKNKRRKREPQEIEEQTITETETKHKYTHSNLLKTLLHRFIKYTKQYYGIDAKYAWLEKQGGLADLMHSNAESAYKHRSIPNMRRRLTNVIPIRVSKIPLAENRRNKDKCNDDKPYERDTAFIFENGKIMFRIGRGKHKVTFKIATRFNDAERLGMLIHAIQGDNGFTIGDPCYLVRKETYNGYRYYIMVSISKNVDVKALYESIKNKSKIRIVGVDSNISKYTATMFCIEVDKENKEYKLINAKGIKSKDYINAVNKYEEERKKLQQGRMKGKKQKKKGSKYKEKEDYTIRNRCGDSKRIDLRRQLIGYICNQILKFADENKADIIVIEDLKGLNKELKHLRIIKKELGKLYNDVNSKGNNAIDDKINEINKKYKNKIRRPLLELLNKIKEYSKNKDRIKVAKYILKQRQIIERRISLLSMMAYYQFKQELEVEALWNGKLLYTINPKYTSQQCLRCNHTNKLNRITQRQFKCIKCKFEMNADFNASANIALRFASEILKLELELKQGESSSMMTATNATTPLHASMNAGSKVSEQGHNDDLVRNGSVASTMSSVASILQDCYERRSPCLGGQTKQSCSVRSIATLDEFLEQKGNVFAMKGNGG

SEQ ID NO: 61879 - protein, 686 aa, Unknown
  Microbial source - Accession No. Ga0370516_008232
MLTITRARTKKITKTMLKLELKGEPNSNSLKFLDNLFNEYKQLVRIADTFIYHLYPYYANITEREKLEGLNKLIRSMERKAIINRRKEKEKKKETDDDFAYQRLPYLFAWLEGKISKESRYTYSHSYLLKTLLHRFIKYAKQYYGIDVKYANLEKQSGLVDIMHNNAENAYKHRTIPNMRRRLINVMPIRVSKRPLPENRRNKDKCNDDKPYERDTAFIFENGKIMFRIGRGKHKVVFKIATRFNDIERLGMLIHAIQGDSIFTIGDPCYLVRKETDNRYRYYIMVSISKNVDVKALYESIKNKSKNKIRIIGIDSNISKYIATMFCIEVDKENKTYKLINAKGIDSKAYINAVNKYEEERRKLQQGRMKGKKQKKKGSRYKEEEDYTIRNRCGDSKRIDLRRQLIGYICNQILEFANENDADIIVIEDLKGLNKELKTLRIIKKELGKLYKDVNSKGNNAIDDKINEINKSKKYKTRRPLLEILNKIKEYSNTKDKVKVAKYIIKQRQIIEKRMSLLSMMAYYQFKQELEVEALWNGKLLYTINPKYTSQQCLRCNHTNKLNRITQRQFKCIKCNFGMNADFNASANIALMFATKILKLKLELNPKQGKDSSTVTSTAIPLHASINAGSKLGVVADTLSSVASTALQGEGEGRLPCLRGQTDKPCSAKRSIATLDEFLEKKGNGG

SEQ ID NO: 61880 - protein, 672 aa, Unknown
  Microbial source - Accession No. Ga0370516_009639
MLTDTRTKVKKITKTMLKLELKGDPKNLKFLDNLFNEYGQLVRIADSFVYYLYPYYANINEQEKLERLKELVQSLDEKAIRKNKRRKREPQEIEEQTITETETKHKYTHSNLLKTLLHRFIKYTKQYYGIDAKYAWLEKQGGLADLMHSNSESAYKHRSIPNLRGLSNVMPIRVSKRPLLENRKSKDNDEYYKRTAEFIFNNGKIMFRIGSKHKGLTFKIAERFNDTERLVILIDAIQGKNDLTIGDPCYLVRKETDNRYRYYIMVSISKNVDVKALYESIKNKSKIRIVGIDSNISKYIATMFCIEVDKENKEFKLINAKGIKSKNYINAVKKYEEERRKLQQGRMKGKKQKKKGSRYKEKEDYTIKNRCGDSKRIDLRRQLIGYICNQILEFADENNADIIVIEDLKGLNKELKHLRIIKKELGKLYNDVNSKGNNAIDDKINEINKKYKNKIRRPLLELLNKIKEYSNAKDKVKVAKYIIKQRQIIEKRMSLLSMMAYYQFKQELEVEALWNGKLLYTINPKYTSQQCLRCGHINKLNRITQRQFKCIRCNFEMNADFNASANIALRFATKILKLNLKQEQGESSSMMTATNATTPLHASINAGSKLGVVIANNNTDGSVASTMSSVASNLQGCDEGRSPCSRGQTKQSCSAKRLVTLGEFIEKKGNGG

SEQ ID NO: 61881 - protein, 405 aa, Unknown
  Microbial source - Accession No. Ga0370516_018229
VGLKPKLLNPRTTFVAVHARLVFTSPEDERAVLDLMRRFSAAYRWIYKRLLEGHDPNELKREGGPMERRFGLNVKYNEGARDLALWKIAVMKELGRPPEKVVFGGRGLFRRLGRKGDLKARLEAKRLWRERRNGLLYCPGDRSQYSGNRNLQLFTRDGALWLRIVLDTTPLTPEERAQSRLFPGESGRTKGHYVDALVQTRSQNLPAILEVVGQKGVAPIGVNLRLHDGRVYATFSRQLPLPVPVYTRQHGVLGVDVNARPFHLALAVVGPDGNLRRYTTIPLEEADRIRERKQGETSRNALENFYWHVAHQVVRLAKEEGVAIAVEDIRRLPKGRRGEGNKRFRRKLHRFAYRAILERIVRVASREGVEVWGVNPAYTSVIGALKYAPMRGLTKDVAAAWVIAR

SEQ ID NO: 61882 - protein, 348 aa, Unknown
  Microbial source - Accession No. Ga0370516_020865
MRVNTKYRTVIIRLYPTPKQEVLLKKAEEEVLKFLHLSRLELQKMLYHKMKEMGIELSMYTVSLLTQRFTGSLGEKAIIPFDTDYNAKFVNDDGIWFVEVQLFKGKGNRIRIPIAKTELPYYEAIDEIQGLPFVITRENNDWFAYVSVPVKAEPSDLVVGVDFNLRMWVASPYEGRPVFFDVREYDQKIDRLQRLRTRYQKRGEEENVNECLRKMKEIVKLAHGNFLARIMERYGVCNLAIEDIEVIYKLTEKDSRMINNWLYSKTALRQFALRAMAKGFNVIEVDPKDTSRLCHKCGNPVRIYGKHERLIACETCGYRDYNRDLNAARNIAKRGSESRNIICPHPSG

SEQ ID NO: 61883 - protein, 422 aa, Unknown
  Microbial source - Accession No. Ga0373397_000168
MKHTKVMRYQIIKPINDTWETLGHVLREIQRETRAALNKTIQLAWEWQGFRAEYKQRYEEYPKTKDHLGYSALHGYAYNRLKDEFYRMNTANLSQTVKRAADKWKSDLKDVMRGDKSIASFKKDCPIDIVSQALRIRKDGSDYILTLSLVSIKYRKELERKQSSFDVLISANDKTQRDILDRLIAGEYKLGASQLLYHKKKWFVNVNYQFEKEETAFDQDNIMGVDLGIVYPVYMAFNNSLHRYKIEGGEIERFRAQVERRKKQLLQQAKYCGEGRRGHGTKTRIQPIEVVSDKVANFRDTVNHRYSRYVVDMAIKHRCGTIQMEDLTGIATDNTFLKSWPYYDLQQKIEYKAHEAGIQVVYIKPDYTSQRCSKCGHIERDNRTEQATFECKSCGFKTNADFNAARNIATKDIEKIIAETLK

SEQ ID NO: 61884 - protein, 426 aa, Unknown
  Microbial source - Accession No. Ga0373621_000479
MGANKEMETIKVTVKATISLKDKGIRKLMREYDAYKKVLISRVKQAVRPIIKDKSIRVYAQQKWMVDKKLNEYLKNLSFHPMPFHRQSVWIEYRKGFLIHFKTAEGEAVCHLHVPEKYYDMILEACGEDNPILGQVELIEDPKYEWINCHIVLRYPKPEPYEPKGWLGVDTGWNKLATSIACEINPHIRFYNPTFHGKDFKTRIIQLRHLLKEYQRKGKKIKMWKNRLKNTIEYAKGMVAKEIVSKAKKHKLGVAMESLTFKAVSKGYLVPRYKLMIAVKTLCEREGVPFKLVPASYTSQTCPKCGYVDEKNRDGERFKCLKCGYQADADIVGAMNISQKAFDSSSDEEENGVGFKPTSKADRGLPREAGRVASPQASMRDDPIERDATQGVARVACKEHCNFAPEESASQIWENCRSRQRTLQLY

SEQ ID NO: 61885 - protein, 378 aa, Unknown
  Microbial source - Accession No. Ga0373621_007959
VNKNNTDLIKVTATCGIDPRDKGIKILMKEYVIFKKNFITKVKGAIRPIVKDRNVRVYSSQKFLLEKKLHEFVKNLPYHPMPTGNQAYWLEKSYYETKNGKKYPCINLHIKTKDGEAVSKLIVPKKYEEYLLKATKKSCPYLHDEKCEFEYCPFETPKMCKKINPHRGELELIEDLKSGYIRAHITLRFPKSKPYEPTGWLGVDTGWNKLAVSIVAKNNPHLRFYAPSIHGKDFKTRIIQLRHKLKELQRNGKVSEVWENRLQNMIKYATGKTAKEIVSKAKKYRVGVAMEDLNFQAVTKGFIVPRYKLMIAIKTHCEREAVPFVLVPAKNTSITCPKCGFVDEKNRNGERFKCLKCGYEADADIVGAMNISKAGVKI

SEQ ID NO: 61886 - protein, 336 aa, Unknown
  Microbial source - Accession No. Ga0373621_010685
MRVNSQYRTVTVRLLPLPEQEILLRKAEMEVIKFLSLSRYELQSMLYHKMKDYGVEISMRSLNLLVQRFTGSLGEKTIIPFDDNAKFVNDNGLWFVEVQLFKERGNRIRIPIAKSEVPYYEAIGELEGLPLLITRENEDWFAYVSIPVKADPNGLIVGVDFNLRKWVASPYIGTPIFFDVREYNEKIDRLQRLSSRYQSREEEEKVKECFRKMQEIVKLAHGNFLSKIMDKYGICNLAVEEVETIYKLVRKENKMINNWLYSKTALRQFILRAMAKGFNVIEVDPKDTTKLCHKCGNPVKIYGKHERLIACEKCGYRDYNRDLNSARNIAKKGKFK

SEQ ID NO: 61887 - protein, 334 aa, Unknown
  Microbial source - Accession No. Ga0373621_017562
MRVSTQYRTVILQAYPDPKQERVLKRCEQSVLKFLEVGRLQLQKMLYHKLKDLDIGRYSLSLLAQRFTGSMGEKALLPFHTDYNARFVEDGGLWFIDAQLLKGRGERVRIPIAKTEVPYYESIQELVGLPFFLARENDKWFAYVSVPVKADPNGTAVGIDFNLRLWVASPYEDSPLFFDARPYSREVDRLQKLIARAQKNEEDVEEHYQSLRGLIKQAHGNFLSAISEKWGICTLVLEDIETMYGMRGLKSKLTNNWLYKKTALRQFALRAMAKGFDVVEVPPRGTSKECHRCGSQLKIYGRHERLVECDKCGLRDYNRDLNAARNIAKGAVDA

SEQ ID NO: 61888 - protein, 347 aa, Unknown
  Microbial source - Accession No. Ga0373621_020135
MKVNSQYRTVIIRLYPLPEQEILLRKAEMEVIKFLNLSRYELQNMLYHKMKECGVELSMYTLSLLVQRFTGSLGEKALIPFDTDYNAKFVNDNGLWFVEVQLFKGKGNRIRIPIAKTELPYYEAIGELDGLPLVIARENEDWFAYVSIPVKADPNNLIVGIDFNLRKWVASPYEGAPVFFDVREYNEKIDRLQRLRSRYQKRGEEEEVKECFRKMQEIVKLAHGNFLSKIMGKYGICNLAVEEVETIYKLVKKENKMINNWLYSKTALRQFILRAMAKGFNVIEVEPKDTTKLCHKCGSPVKIYGKHERLIACEKCGYKDYNRDLNSARNIAKKGSEVSITNSCMVR

SEQ ID NO: 61889 - protein, 356 aa, Unknown
  Microbial source - Accession No. Ga0373621_023545
MPKVFKVAPTVEGNTLKRCVRGAISPRDIGLRKLMREYAIYKHVLIPRVKQAVRQIVKDKTISVYAQQKWMVDKKLNEYLKNLPFHPMPFHNQSVFIENKSGRFWIHFKTKQGEAVCYLYVPAKYHSLIEKACGEDFTRNPVLGQVELIEDKHYGWVNCHITLRLPKPEPYEPKGWIGVDVGWNKLATSILATVNPHLTFSHPTIHGKNFKTQIIQLRYLLKDYARKGKAWKKWDYRLKNTIKYATGVVAKEIVLKAKRHKAGVVMEKLAFKSVTKGYIIPRYKLMVAVKTLCEWEGVPFKLIPAKYTSITCPKCGYKDEKNRLSERFTCLKCGYQADADIVGAMNIAKTASQMEG

SEQ ID NO: 61890 - protein, 405 aa, Unknown
  Microbial source - Accession No. Ga0373621_050562
LDSETARLCVKAVISPYDLGLDKLLHEYKLYKKMLIPKVQQAVKQIVKDKSIPVYSDQKWLVVKKISEYLRELPLHPMLFGNKSYWIEKRGGEFWIHMKTKDGEAICLLNVPEKYRDVVEKACGETCPYMRNSKCEFTKCPFNTPKMCNRINPHRGEMRLAQDARYGWINCHITLRLPKPEPYEPKGWLGVDVGWNKLATSILATVNPHVRFSNPTFHGKEFKTRIIQLRHLLKEAQRRGRVVKTWRNRLKNTTDYAVKVVAKEVASKAKKFKAGVAMEKLTFKPISKGYLIPRYRLMIAVKTLCEREGVPFKLVPARYTSITCPKCGYRDEKNRNDEWFKCLKCGYQTDADLAGAMNIALRALDGTADGAVNDVRHASRLKPRRLYASKAGCVAQPKAAMRDVS

SEQ ID NO: 61891 - protein, 1477 aa, Unknown
  Microbial source - Accession No. Ga0373637_0010996
MSPNATPPVTQRAYTLRLRRAPGRCPKCQNDTCDCWRDALWATHEAVNRGAKVFGDWLLTLRGGLHHTLADMEVPAKGKGSSRAPTQEERRHRRVLLALSWLSVEDEGGAPNGDGLRVTTGRYSDNDRREAVEAALREILEKRGVQPSEIEEWVRDCGPSLAARIRKDAVWVNRSALFDAVCGGQNVRQAREDARTLLWYLLTDHYLALPKTDKKQSEGSDEDQEDGEEKEPTVDAAAEAVAKSAKGAGQRTRHLFSHIFGRKSTQGFGKPRRKLDLREHWRGYLKPRIETAGIPLSDPDVKAKKKAALSPTEVHREMFSKAASRLAQTWTRQKQQEVARQLGAAADEELNKLEGDKAYCKALELLDAYCRERGQASGSLEEYRINPRAAEGWERVVVAWERINEADRAKATEKRIDEVKRLQSENFDKKFGDINLFVDLAEPEYEPVWQHNGQATPSILKTYVKGWKARTDAARLKVAAFRHPDPYFHPVFCQFGVSRPPIQYGRLGTNWDGDTRTVRMRVWNGSRAVDLPLLAVSKRFDAEIGSASESMEKAEPEVTRRSRLAIAAVPNGRIQGNRFRVASVFDQQDVRSRQKADNGTQEDTDDEDSRNGKDKEKKKEPTWNGTLQADRWALKSIGRLPCSDLQKKQQAKRRLQWRLTVALELQPIGPWYDYVRNAADPFPFQRTIRKNDKGIKRQKEKKYLSINGWPFEEINKPLRDGGAKLVVDKQSVRGRDANVILSRLPGLRILSVDLGHRFAAACAVWEALPKDKFEKEIANLEALAGGSGKDDLYLHVAKPGDDGKTRTVVYRRIGPDDLPDGKAHPAPWARLDRQFLIKLQGEDEEAREASNEEIWAVHQLEAELGRAVPLIDRMVRGGFGQKVEQKWRLEALRGLGWRPAATNVPPGAADEEEGEARKISRSVDELMSAAVRAMRRSLKRHGDRARIAFAMTADYKPMPGDRKYYFNEARDASRGDDAASRRGKRVEFLQDALSLWHDLFSSRGWKDDAAKVLWDEHIATLLGYQTPEETAENLTNVERKKKRKEYRDKLRAAAEALAVDDRRRAELHEAWKKRWESDDAQWNKRLRWFKDWILPRGKAKKDPGIRHVGGISLVRLATLTEFRRKVQVGFFTRLRTDGTRAEIEESFGRSALDALDRLREQRVKQLASRIVEAALGLGRVKTPKKGNTPKRPREAVDASCHAVVIESLTHYRPDDLRPRGENRQLMTWSSSKVKKYLAEACQLNGLHLREVPAGYTSRQDSRTGAPGIRCQDVPVKEFMQSLFWRKQVAQAEKKVTDGKGDACERFLVDLNAKWKDQTEAAWKSAGSVRIPLKGGELFVSADPGSPAAKGIQADLNAAANIGLRALLDPDWPGRWWYVPCKPGTSEPALDRIKGSAAFEGVQVLPADGAAPAGSEAGKRQPKKSKSKAPKKIEYLWRDPSGGVLAAGRWKQTQAYWNDVQYRAVQLLRKRAGLDSYG

SEQ ID NO: 61892 - protein, 1352 aa, Unknown
  Microbial source - Accession No. Ga0373637_0021496
MSNKTTNQKSIWSEFTKQYALNKTLRFELKPVGRTEDFLKQNKVFEKDKTIDDSYNQAKFYFDKLHQKFINESLSLNNAKAIDLKYFAEQFLKLKSQIQKLKSENKKEEVNKKEKEINNLRNDYYKKIKSLLDKKAKEWKEIYKKKEIKFSKSDLEQKGTDFLMKSGILGILKYEFPKEKEEEFKSKDYPSLFVADKANPGNKVYIFDSFDDFATYLIKFQETRKNLYKDDGTSTAVATRVISNFEKFFNNKKIFEDKYINYWKQVGITEEEKKIFEIDYYYSCFTQEGIDEYNKIIGQINQKSKQYRDKNKVEKSELPLFKVLDKQILGEVIKERELIVKTETETEEEVFIKRFKEFIDQNKQRIPKAQNLMNDLINEKFENEYSGIYLKNSAINTIANRWFKNAIEFLRKLPQASKSKENKESPKVKPFVSLLDIKDALDEFEKERESLGSIFKDKYYKTKESDEVPLNNDRESYWKQFLKILGYEFNQLFEDKFNEEGIKTFWGYTKDLEKEAENLNSFSRKKEEITVIKNYCDASLRIYQMMKYFTLEAKKQDDIPLDYSTEFYNRFNEYYQDFKFVHYYDAIRNFVTKKPSNEDKTKLNFESGSLLTGFDKNKESEKLGIILKNKNNNKYFLGIINKKHNKIFELKNENEFIGNPAKDLYEKMELKLFPDPKKMIPKIAFADKNKKYFGWIQEIQNIKKDFENFQKNKKGNQDLKFDKNKLSKLIEYYQNCLEKGNYKKEFDFEWKKPEEYQSMSEFNQDIEKKNYKIKFIPVKDSYIDDKVKNGELYLFEISNKDFIWLNQKKNIHTLYFLSLFSEKNIQKPIFRLGANAEIFYRQKSEKATKEKRGGKEIIKYKRYTEDKIFLHLPIEINYGCPKAPNKNQYNKKVIEFLNKNKDEINIIGIDRGEKNLLYYTVINQKGEILDHGSLNEINGVNYLEKLIEREKERQINRQSWEPVVKIKDLKRGYLSYVVRKIADLVEKYNGIIVLEDLNMRFKQVRGGIERSIYQQFEKQLIDKLGYLVFKDYRDSDAPGGVLNGYQLVAPFTTFKDLGKQTGIIFYTNAEYTSKTDPITGYKRNIYISNSTSQKKIKENLINKFRAIGWDEKEKSYFFTYNQKDFNSPISKEWTLYSKVPRVRREKNNSTGYWEYKPIDLNKEFEDLFKKYEINEKSKDILSEIKELIKNNENKLTQKQEFDKKNKNFYERFIYLFNLLLEARNTISLQIKLDKRGNEIKLDEIDYGVDFFASPVKPFFTTAGVRFVGKQIEGGKIQKEKKEKFAIKNFADFERLFKGCSSDGFDSDGIGAYNIARKGIIILERINQNPKNPDLYISKEDWNDFAIKNALVK

SEQ ID NO: 61893 - protein, 1485 aa, Unknown
  Microbial source - Accession No. Ga0373637_0024972
MSQNPAPPVTQRAYTLRLRRGPGKCPACQKDACDCWRDALWATHEAVNRGAKAFGDWLLTLRGGLCHTLADIDVPAKGKKPARNPTKQEQRDRRVLLALSWLSVEDERGAPNGDGLRIATGKEPADKRGEAVKAALRNILGNRGVNASEADSWVKDCEASLAASIRDDAVWVNRSAAFDAACNGQNLRQAREDARTLLWYLLTDDYLVLPKANKKESEDTGEDQEEGQDEESAVDEAAEAVAKSAKGAGQRTRHLFSHIFGRQSTQGFGKPPCQLDLRDYWQGHLKPLIEAAGIPLSDPNVTAKKGAAPSPTELHREMFSKAASRLAQIWTKQKQQEVARQLRAAADDELKELESDQTYSKALDLLEAYCRERGQITGSLEEYRINPRAVEGWERVVAAWEGIKSSDPTEAQQRRIDEVKRLQDESDDKKFGDNNLFVSLAEPEYEPVWQHKGQATPSVLKTFVKGWKARSDAARLKVAAFRHPDPYSHPVFCQFGVSRPWIKHGRLDPKGNAGTVQMLLWTGSKADKVQISAVSKRFDAEIGSASESTVIAARQVARRHRLAVAAVSTSGAGVNTIRVAHVFDQQEVRSRERAVEHGIEDENGDDESQNARKKGPIWNGTLQADRQALKAIGKLASSQKAPQAYRCLQWRLTVALELQSSGPWYDYVRNATDQSPFQRTVRKDEDKGKKRKKGTKYLFLDGWPFEEVNNPLKVNRVDTLLLADKRSARGREAKIVLSRLPGLRVLSVDLGHRYAAACAVWEALPNAAFKGEVAGLKVRAGGPGEDDLYLHVEKPGDDGKTKTVIYRRIGPDSLPDGQFHPAPWARLDRQFLIRLQGEDEEAREASNEEIWKVHQLEAELGRTVPLIDRMEKGTFGQTEKQKQRLEALRGLGWTPATTNVPPGAAGEEEGETRIVSRSVDELMFAAVRTMRLALRRHGDRARIAFAMTGDHKPLPGGRKYYFDEAKGASASDDEATRRSKRIEFLQDALALWHDLFSSRGWKDDAAKKLWEQSVATLSGCQTPEEIAEDLTAIKRKKKREENRDRLRAAAEARAAAEALAAAEALAADDRRRKELHDAWTKRWELDDAQWKRRLRWFKDWVLPRGKAGNDPGIRHVGGLSLTRLATLTEFRRKVQVGYFTRLHPDGMKRETRESFGQATLDALDRLRDQRVKQLASRIVEAALGIGRIKTPKGGKMPKRPGKAVDDPCHAVVIESLTHYRPDDLRTRRENRQLMTWSSSKVKKYLAEACQLNGLHLREVPAGYTSRQDSRTGAPGIRCQDVRVKEFMQSPFWRKQVAQAEKKRADGKGDARERFLFDLNTKWKSQTEAAWESAGSVRIPLKGGGLFVSTDPRSPAANGIQADLNAAANIGLRALLDPDWPGRWWYVPCKAGTSEPASERIKGSAAFKNVRGLPADGADRAGSEASTGQPRKNKGGASREIENLWRDPSSEGLAAGHWKQTQAYWNDVQYRAVQLLRKRARLDSDG

SEQ ID NO: 61894 - protein, 1289 aa, Unknown
  Microbial source - Accession No. Ga0373637_0031827
VWDILEPFFGTRAAYFAGLEDGEEEDEATHEEEEAKDLVQKAGQWLSARFGTGTGADFDAMAGAYKRIARWAVRASSDYPGKETIHRLATCLKLSGSCDLNGVLRVISGPGYKSATRNHLKTMYGKSKVAREDLDRLKELAEQDAAKCKGNVGRKGQRAWADLVLKDVEKACGFTYLQNDGPARHREFSVMLDHAARRVSIAHSWIKLAEQRRRQFESDAKKLNELRKRAANAVVWLDQFCADRSTATGADTEGGYRIRKRAVEGWTHVLKTWARPSCNTGEERIAAAREVQADPEIEKFGDIQLFEALATDEAVCVWRDQAGKPDASILIDYVVGTTAEHNQKRFKVPAYRHPDALRHPVFCDFGNSRWAIRFAIHDAVGARSKGKRAKTDTNWLQNRHGLRIGLWSGNSVGDVDLQWSSKRLTKDLALDDNPAATATSVTRADRLGRAASGAFGPAAIKNVFEEKDWNGRLQAPRAQLDRIAELEDRGHHAQAEGLRQRLRWLVSFSPRLRPSGPFIEYAASQGIEPNRKGEYYPNAPANKGREGLAKLILSRLPGLRVLSVDLGHRFAASCAVWEAVPNAAFKEEIAGLKVLAGGPGKDDLYLHVAQPGNDSKTRTVIYRRIGADNLPDGKAHPAPWARLDRQFLIKLQGEDEEAREASNQEIWAVHKLEAELGRAVPLIDRMVRGGFGETDNQKRRLEALRGLGWRPAATNVPPGMSDEEEGEARTISRSVDELMFSAVRAMRLALKRHGDRARVAFAMMAEFKPMPGDRKYYFNEARDASAGDDEQSRREKRVEFLQDALSLWHDLFSSRGWKDDAAKVLWDKRIATLPGYQTPEEIAEDLTGAERKKKRKENRDKLRAAAEALAADDQRREELHEDWKKRWESDDEQWNNQLRWFKDWVLPRGKAGDDPGIRHVGGLSLARLATLTEFRRKVQVGFFTRLHPDGTKPEIKESFGQATLDALDRLREQRVKQLASRIVEAALGIGRIKIQKEGKSPKRPRMAVDTPCHAVVIESLTHYRPDDLRTRRENRQLMTWSSSKVKKYLAEACQLNGLHLREVPAGYTSRQDSRTGAPGIRCQDVPVKEFMQSPFWRKQVAQAEKKGADDKGDARERFLVDLNAKWKGQTEAAWKSTGSVRVPLKGGELFVSADPRSPAAKGIQADLNAAANIGLRALLDPDWPGRWWYVPCKAGSSEPSPDRIKGSEAFQGVQSLPADGAAPAGSKAGIGHSKKNKGKTPKEIENLWHDPSSEGLAARHWKQTQAYWNDVQYRAVRLLRKRAGLDSDG

SEQ ID NO: 61895 - protein, 553 aa, Unknown
  Microbial source - Accession No. Ga0373637_0034837
MPFGRTAGPTIVYKYGAKKPTTNAEAILEQLRKAHQYRNKLVEIELQRRKLVEEAVKNIESDVRHLANKLEQLELDIDYTVRKINNHKQKNHTRTTPAELKEHLKSLKTQYREALRQMKEAKKAAYARPETQEALNRIAGKVRAEHKKARNLCGLYWGTYCHVEQITTHIRKGPPPKFRRFAGSGVLAVQLQKGEDIARLESGEDRRIRIEGCGKRRILWLRIGSDENRYPIWATIPFTYHREIPSDAKIKWVKIKAQRIACQTEWEVLFTLERSSGWKKPDLAQDGVVAIDIGWRNFDDRIRVAYWIGSDGCEGEVALPHNMVGKALEQVEHLRSLRDKNFNEIKQQLLDAIGVLQIPEWLKEATKTLHQWRSQGRLAALAIRWRQQRFDGDNDIFALLETWRVRDKHLYEWEAHLRVKAIRRRNDYFANVVANLSRRYKTAIVEDFDLRSVTQVDPTQTEQVGDGRQLYRAHIAAAGGLRQMIKNRFAETQIVSSVLTTQTCTECCEVMNFAAAESVFGKCPHCGHTFDQDRAAAINLMRRYEERLVAANS

SEQ ID NO: 61896 - protein, 1209 aa, Unknown
  Microbial source - Accession No. Ga0373637_0065620
MKHNSTFENFTGKYSLSKTLRFELVPQGKTKETFSKWIKELENQTADEKKNLLHQDIMRAQKYEKVKKILDEYHKDFIEQALSALGKAKLQGLDEYKRLYDIKKKEKKEAEEFENIKTSLRKQISKALKAHSGFTMLNKDDLFKGKKNSDDGRLLQKFLNDNHKVKQDLEATLRENENDHINLFDLLKSFESFTTYFKNFHENRKNLYSDEDKFSTIAHRLVHENLPKFIDNIRIYEKAKTAGLNVDAIQEQLQQERLLDDIFSIEYFNETLTQQGIDDYNYILGGRAVDPGKPNIRGVNSFINNDINQKAENNKDRIPVMKPLYKLPLFERTSSSFRFDPIENDADLIQRIKSFYYHELLQYREETESEAEPLNILARLKELLKSITDFRDGLYVNGGLTLTQISAKIFGNWNYIGNALSDYYDKHVDPPKPDKKGNPKPVTKKQEEAKRKWLKQKQFPVSLIEKALSEYRKKETNEEVKSKITDTTLCDFFKKCGANEDGKNDLFARVEFKLTDKNEKGETLEELLNTDFASDKKLMQDKPKTLLIKNFLDALQGNFDDISAGLLHFIKVLKPREEVSDKNETFYSEFEKYYKALSEVTPLYNKARNYLTQRPYSVEKVKLNFENSTLLDGWDENKEADNSCVLFRKDGFYYLGIMDKNHRNIFKEYPKANHGESSYEKMIYKLLPGANKMLPKVFFADSNLQHFNPPEDILRIRNTASHSKNGNPQEGFVKAPFSQADCHKYIDFCKASIAKHWDWNSFGFVFSPTNQYADSSDFYKEIERQGYKITFAHVPESYINQLVDDGKLFLFKIWNKDFSLNKKVQNRNSKPNLHTLYWRLLFDNRNLSDITLKLNGEAEIFFRKKSIPEDKLTVHEKGKPIENKNPFNKKKESVFDYDIIKDKRFTVDTFHFHVPMTLNFGADGSDNINSEINAFLQNNHDINIIGIDRGERHLLYYSLINQKGEILKQHTLNLLGNQNYRDLLDKREGDRDEARKTWNLIENIRNLKEGYLSHVVHEIAKLMIEYNAIIVMEDLNFGFKRGRQKVEKQVYQNFEKMLINKLNYLVFKDRQPDKPGGVLRAYQLANKFESFKKLGKQSGVVFYVPAAYTSAIDPITGFVNFLQPLKADSIEKSKKFYGKFKSIRFNPEKQWFEFDFDYTDFIDKAVGKTNWVACTTNTERYAWNKSLNNGKGDQELVRVTQELEVLFGD

SEQ ID NO: 61897 - protein, 605 aa, Unknown
  Microbial source - Accession No. Ga0374803_055
MRYRNSRDVVGKVKSVTVSKHAGKWFVSIQTEREVDRPIPQGGAVGMDMGIARLATLSDGTFYAPLNSFKRHEARLRKAQQALSRKVQFSNNWKKAKARLQRIHSQMANARRDFLHKVSTAICKSHAMVCIEDLQVRNMSKLAAGTADAPGKNVRAKSALNKAILDQGWYEFRCMLEYKLAWKGGRLIVVPPQNPSRTCPCCGHVSSDNRQTQAWFECVACGYENNADRGSGPEAFRGSGPEAFRGSGPEAFRGSGPEAFLVGAINILACGIQLLRDEGQDTTDAAVGMRVGEPPVSARMACGSNRTGGRKQEPAETTAQGAIHAQRGRNLQPSGRGGCQHSLPSGSAQVRIKKQRSHPQAHFCLPVNPVRTLSATKAAFFSAYPRPINAVYRRVVEELLVELHLTTVNSTFVYDPFFALGLVTLYDGLMEAYHPPEQREAIFNALCKALHLKPEVLRKNARDLLELMGSGDPRQRLDLLCLKPEAEDVGGLKAILERMTQPPYAYSRVLAVGLYTAYEVVAKSLYEEPEERTRRFLENVVSKLPFSTERVRKDLELYRSSLDRMKQARAVVEEMVKAARRQQERRQSAASLPETSLGDPSKPGS

SEQ ID NO: 61898 - protein, 676 aa, Meiothermus silvanus
LRSGCISSRPQRRWFAWLWPGRWTRRVPSPLPWRQAPRNEPWSKLRGWKEIATTRQPWPTWWPGWPTRATPKPDGTWPRAFWPGFLGTGFARTEGKPPLQRAGEQGAPIELAFQSPTGLLALPDPSIPQRTFGSSKEGGEMPFGKKARHVKAYQFGADAPQEGMEAVLEQHRLRTDYYNALVEMELRQREERTALLANLAAESGLESPNQVYERLKAAGEKGIRKHPEYVAARERQKALYGHPRLLELQSRQREERNALRRSFGAKGLYSSNYLDVERAFDKARQSPELRFRRYSPHEGRLAVLYTEGLPMREIGSDTRVQLPLPDPIIYRDRATRRKHQRVLMKFRVRSVERQPLWITVPVYLHRELPDGVCREVSLHWHRVADRLRWTVSVVVEVEGPPVASPTGRGAVAVDLGWRRVEGGLRAGFWVGEDGAGGEIALSEGDLKQFSKVEDLRSIRDQHLNALKEALAAWLEAPPAPLPDWLAEETKTLPQWRSPARFAALFRRWQSERVHADEAAYGLLEGWHKRDRHLWQYEANLREQMILRRREQYRVLAATLARQYDALIVEDFNLRAAAELDQGGSDLPDAARRYRTIASPSTLRDALVNAFAQRGKPVRKLNPAHTTTDCHACGGALVGDPAKELRLYCPTCERFYDQDENAARNLLRRAQEVQAQV

SEQ ID NO: 61899 - protein, 447 aa, Alicyclobacillus acidoterrestris
MIVKTMPYEIIKPLSCDWAVFGEMLRRLRDESFRIKNSAIQYFYEDDIKRREFKKNNGRFPKKGEFYGSSVSVYNYVRPDVKYSAMGNVTLINQLVKSVWIKYKDDVVKRNMSIPSYRPNNPIEINVQSFNSFDFGQACVNLLSRKGVEELKKKLSEVKKKKNKTGGDDNLKFTQEQLNGISTSVTFAFNPGKNNAKQVLNRIISGEYKLSSSKIIYNERKNKWMLAVAYKFEPKTIELDKNRVLGIDMGVVYPAYMAVNYDKYWRDSIDGGQIEQYRKTVEARRRRLQRQAAVCGNGRIGHGRKKRMQPLEKISDKVANFRNTVNHTYAKKIVQNAVKLGCGTIQMEELSGINEKETFLKRWTYFDLQKKIEYRAKEYGIDVIKINPKYTSQRCSECGYIDERNRPKVPDQSKFKCLSCGYETNADFNAARNIATPYIDKIISLNS

SEQ ID NO: 61900 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 61901 - protein, 1108 aa, Bacillus thermoamylovorans
MATRSFILKIEPNEEVKKGLWKTHEVLNHGIAYYMNILKLIRQEAIYEHHEQDPKNPKKVSKAEIQAELWDFVLKMQKCNSFTHEVDKDVVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPFTDSNEPIVKEIKWMEKSRNQSVRRLDKDMFIQALERFLSWESWNLKVKEEYEKVEKEHKTLEERIKEDIQAFKSLEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKFVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKLVTTHADINAAQNLQKRFWTRTHGFYKVYCKAYQVDGQTVYIPESKDQKQKIIEEFGEGYFILKDGVYEWGNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 61902 - protein, 1076 aa, Sulfobacillus thermotolerans
MSARNIKVKIDTKGNPELRLGLWKTHQVTNEGVKYYTEWLIKLRQQDIYRQSREDASPRVIISASDLKADLLCHARQLQKERLPRITGSDAEILGTLRQVYELIVPSSVGKSGDSKTLARKFLSPLTDPGSAGGRDQSASGRKPTWMKMKSEGNPRWEETFRKWKDRKDNDPTPLVLNQIADYGLLPLIPLFTDVGENIFDPKSKSQFVRTWDRSMFQQAIERLMSWESWNQRVRREWEALNQKHSAFYREQFTADPDAALYRVAQSLEEEMRKEHQGFASDAPEAFRIRRVALKGFDRLLERWQKTLGKNGQSATLLDDIRRVQSDLGDKFGSAPLYQKLLDERWQRLWAVDPTFLQRYAAFNDLTQRLQRAKRVANLTLPDAVAHPIWSRYEGANASSGNRYHIHLPTKGQPGSVTFDRILWPDGNGGWYERKRVTVFLRPSHQVDRIHEAPTDSVVDNFPLVVEDQSARTILRASWGGAKLEYDRNRLPRQLKKGVPDSIYLSLTLNLDTNKPSGLFHTQQNGRVWIRKDVLMQYYNETPGDNVQFKPLYVMSVDLGIRSAAAVSIFSVQLKAGIEEHRLTYPVADCPGLVAVHERSVLLTMPGERREQWDRRYEQQRQGLRELRTDMRGMNDLLRGAYMDGDRREEFLARLSKLEETSPELWGPVYRSLNDSKVASATEWERLVVYCHRQVEQSLSSRIQNLRSGRSAYRMSGGLSLDHVQDLERIRGIIASWTNHPRIPGSVVRWQQGRSHTVALGRHILELKRDRVKKVANYLIMTTLGYAYDSKRARGEKWVRRYPACHLMVFEDLTRYRFRTDRPRSENRQLMRWTHQELIAVTGIQAEPHGISVGTMYAGFSSRFDAVTKAPGVRGATVRQILRTRGMVRLKEIAADVGIDINTLRPHDVLPTGDGEYLLSVVRHGESYRLKQVHADINAAHNLQRRLWTQDEVFRVSCRLALNSGRVVAMPPPSYNKRYGKGFFEKGDNGVYIWKTGGKIKISDTLEEDMDIPEDTAELLRGNSVTLFRDPSGTIAGGNWLEAKEFWGRVNSLVNKGVRDKILGGIPVDNSSAHAE

SEQ ID NO: 61903 - protein, 1090 aa, Laceyella sacchari
MSIRSFKLKLKTKSGVNAEQLRRGLWRTHQLINDGIAYYMNWLVLLRQEDLFIRNKETNEIEKRSKEEIQAVLLERVHKQQQRNQWSGEVDEQTLLQALRQLYEEIVPSVIGKSGNASLKARFFLGPLVDPNNKTTKDVSKSGPTPKWKKMKDAGDPNWVQEYEKYMAERQTLVRLEEMGLIPLFPMYTDEVGDIHWLPQASGYTRTWDRDMFQQAIERLLSWESWNRRVRERRAQFEKKTHDFASRFSESDVQWMNKLREYEAQQEKSLEENAFAPNEPYALTKKALRGWERVYHSWMRLDSAASEEAYWQEVATCQTAMRGEFGDPAIYQFLAQKENHDIWRGYPERVIDFAELNHLQRELRRAKEDATFTLPDSVDHPLWVRYEAPGGTNIHGYDLVQDTKRNLTLILDKFILPDENGSWHEVKKVPFSLAKSKQFHRQVWLQEEQKQKKREVVFYDYSTNLPHLGTLAGAKLQWDRNFLNKRTQQQIEETGEIGKVFFNISVDVRPAVEVKNGRLQNGLGKALTVLTHPDGTKIVTGWKAEQLEKWVGESGRVSSLGLDSLSEGLRVMSIDLGQRTSATVSVFEITKEAPDNPYKFFYQLEGTEMFAVHQRSFLLALPGENPPQKIKQMREIRWKERNRIKQQVDQLSAILRLHKKVNEDERIQAIDKLLQKVASWQLNEEIATAWNQALSQLYSKAKENDLQWNQAIKNAHHQLEPVVGKQISLWRKDLSTGRQGIAGLSLWSIEELEATKKLLTRWSKRSREPGVVKRIERFETFAKQIQHHINQVKENRLKQLANLIVMTALGYKYDQEQKKWIEVYPACQVVLFENLRSYRFSFERSRRENKKLMEWSHRSIPKLVQMQGELFGLQVADVYAAYSSRYHGRTGAPGIRCHALTEADLRNETNIIHELIEAGFIKEEHRPYLQQGDLVPWSGGELFATLQKPYDNPRILTLHADINAAQNIQKRFWHPSMWFRVNCESVMEGEIVTYVPKNKTVHKKQGKTFRFVKVEGSDVYEWAKWSKNRNKNTFSSITERKPPSSMILFRDPSGTFFKEQEWVEQKTFWGKVQSMIQAYMKKTIVQRMEE

SEQ ID NO: 61904 - protein, 351 aa, Tepidiphilus succinatimandens
MTNIAQRLLVGNGRQHLVRRRLRRRDAAGGKHILDGRDDLFEKPRPAEYVAAAQAHLPLGVRLRRGGHFESDRHDGIEFEKVRDIVDEGQRLAGVDETDRRCIACGKHRRFGDAVERCGGSRQAAIGSVGGLPGFGIVVTMHPAHFVAFGQPLVHFAHARPLDAAKLLDGASLRRLLTEANGEHAAHDFEAQLIVQGELCLIQQPVGTGTARLPGRIEANAGLTHPNEQGTHPRRERAGGMRDARAGLQHQAGHAAHGDMGAHPVDIHDDESAVEYANPAYTSQTCSCCGELGKRSKHRFECPHCGLRAHSDLNASRNLARIGSGAPLSRAVVNTPDVGSVDMGNHVCASQ

SEQ ID NO: 61905 - protein, 352 aa, Tepidiphilus succinatimandens
MTNIAQRLLVGNGRQHLVRRRLRRRDAAGGKHILDGRDDLFEKPRPAEYVAAAQAHLPLGVRLRRGGHFESDRHDGIEFEKVRDIVDEGQRLAGVDETDRRCIACGKHRRFGDAVERCGGSRQAAIGSVGGLPGFGIVVTMHPAHFVAFGQPLVHFAHARPLDAAKLLDGASLRRLLTEANGEHAAHDFEAQLIVQGELCLIQQPVGTGTARLPGRIEANAGLTHPNEQGTHPRRERAGGMRDARAGLQHQAGHAAHGDMGAHPVDIHDDESAVEYANPAYTSQTCSCCGELGKRSKHRFECPHCGLRAHSDLNASRNLARIGSGAPLSRAVVNTPDVGSVDMGNHVCASQY

SEQ ID NO: 61906 - protein, 1144 aa, Alicyclobacillus macrosporangiidus
VAVKSIKVKLMLGHLPEIREGLWHLHEAVNLGVRYYTEWLALLRQGNLYRRGKDGAQECYMTAEQCRQELLVRLRDRQKRNGHTGDPGTDEELLGVARRLYELLVPQSVGKKGQAQMLASGFLSPLADPKSEGGKGTSKSGRKPAWMGMKEAGDSRWVEAKARYEANKAKDPTKQVIASLEMYGLRPLFDVFTETYKTIRWMPLGKHQGVRAWDRDMFQQSLERLMSWESWNERVGAEFARLVDRRDRFREKHFTGQEHLVALAQRLEQEMKEASPGFESKSSQAHRITKRALRGADGIIDDWLKLSEGEPVDRFDEILRKRQAQNPRRFGSHDLFLKLAEPVFQPLWREDPSFLSRWASYNEVLNKLEDAKQFATFTLPSPCSNPVWARFENAEGTNIFKYDFLFDHFGKGRHGVRFQRMIVMRDGVPTEVEGIVVPIAPSRQLDALAPNDAASPIDVFVGDPAAPGAFRGQFGGAKIQYRRSALVRKGRREEKAYLCGFRLPSQRRTGTPADDAGEVFLNLSLRVESQSEQAGRRNPPYAAVFHISDQTRRVIVRYGEIERYLAEHPDTGIPGSRGLTSGLRVMSVDLGLRTSAAISVFRVAHRDELTPDAHGRQPFFFPIHGMDHLVALHERSHLIRLPGETESKKVRSIREQRLDRLNRLRSQMASLRLLVRTGVLDEQKRDRNWERLQSSMERGGERMPSDWWDLFQAQVRYLAQHRDASGEAWGRMVQAAVRTLWRQLAKQVRDWRKEVRRNADKVKIRGIARDVPGGHSLAQLDYLERQYRFLRSWSAFSVQAGQVVRAERDSRFAVALREHIDNGKKDRLKKLADRILMEALGYVYVTDGRRAGQWQAVYPPCQLVLLEELSEYRFSNDRPPSENSQLMVWSHRGVLEELIHQAQVHDVLVGTIPAAFSSRFDARTGAPGIRCRRVPSIPLKDAPSIPIWLSHYLKQTERDAAALRPGELIPTGDGEFLVTPAGRGASGVRVVHADINAAHNLQRRLWENFDLSDIRVRCDRREGKDGTVVLIPRLTNQRVKERYSGVIFTSEDGVSFTVGDAKTRRRSSASQGEGDDLSDEEQELLAEADDARERSVVLFRDPSGFVNGGRWTAQRAFWGMVHNRIETLLAERFSVSGAAEKVRG

SEQ ID NO: 61907 - protein, 601 aa, Tepidibacter thalassicus
MIRTIQVKLHNLSNYKQNLLDNLFQNYTKAYYEMLNYAKENLDVIEKDYKLKNGSYKGETIAKFFKGTEIHKKYNLEPLGDSLKKDVGCSIASYLELKQANADVSFPETNKDRINVLYEKINELLNEISFNTSLSKEQCHNLEQEIKNLYRKINNINKYRPISFARYDFNRDACLLYNPKKNSYYAKLYVFNKITSKEHVKLYKQKSIKHKDDIKLYYLPTLEIYKENRSIAYIIVPLAFGKWHERFLKQARKRKMKFCAMKLIKRGEDFYLDIPLNEDIETRAEKKKRYEEQNKNGEVLRKIKKKKKEFKNKLGIDLGITNIATIAVLDKDNNLLFSKQFNGNEYKEKFEIFVKKLAIMQMHGSSKYPRDKKYISGILHRVANEIIDLSKKYEAQIYLEDLNIDKSHERIKSTKKFENLPNKLVKRVVKNINRWAYGQMYRILVEKCEREGLPKLIRLNPRYTSENCSRCGHNEKVVSKGERVNRESQERFVCKNCGLQINADVNAAINIATKYSKVVSFKSKEVNGYKVINHELFDFKGIGKDNIEALNDFINKLREYKKEYDKIPFEIRKSDKKLRGQYKILKDVDREDYENYYNVED

SEQ ID NO: 61908 - protein, 660 aa, Unknown
  Microbial source - Accession No. JGII2383J13903_1002647
PKATSERTYRKINYKLLPGASKMLPKVFFSDKNTSYFSPDEEIQRIRNHGTHTKNGDPQEGYEKLDFNLNDCHKMIDFFKSSIQKHKDWKNFGFRFSPTYTYDSIDAFYREVEAQGYNITFTEIDESIIDRFVEEGKLYLFRIHNKDFSPFSKGRPNLHTLYWKAIFSPENLKNVIYKLNGQAEVFYRRKSIQPEQMVIHKSGEAIDNKNPLTGKKQSTFHYDLIKDKRYTVDKFQFHVPITLNFKASESNIINYEVLQYLRTQPDVHIIGLDRGERNLIYLSLINQKGELLYQEPLNALKSDKFNVVTNYQELLARREKERDMARKSWGTIENIKELKEGYLSGVVNKIATLMVKHNAILVMEDLNTGFKRGRFKIERQVYQKLEKMLIDKLNYLVFKDKSEDEPGGLFKALQLTNKFKSFKEIGKQNGFIFYVPAWNTSKIDPTTGFVNLFYIHYENMEKARAFFGKFQSISYNHDKGYFEFAFDYNDFTTKAEGCRTNWTVCTHGDRIRAFRNPEKNHQWDYKTIHITEEFMALFRKYGIEFSGNKDLREIITGQKDAAFYKSLLDLFRLTLQMRNTNQDWDYLISPVLNENGEFYDSRKADNHLPQDADANGAFHIAKKGLMWLKQIQQFEGDNWKKLDLDKTNKGWLRFAQGYQF

SEQ ID NO: 61909 - protein, 1151 aa, Unknown
  Microbial source - Accession No. JGI24108J20142_1001595
MPQQDKPPVTRRAYTLRLRGTDPSNTSWRKALWQTHEGVNKGAKKFGDWLLTLRGGLDHTLADAKVKVGKGKPDRDRTDEERKARRILLALSWLSVESKIGAPVGHIIASGEEVAEDRNSKVVAALEEILKSRGLANSEIKEWKNDCSASLSAAIRDDAVWVNRSKAFDDAVKSTVGSSLTREEAWDMLERFFGSRDAYLAPVKISEDESSEVEQEEKAKDLVQKAGQWLSSRFGTGKGADFSHMAKVYERIAAWTDNAQVGTTGNEAINNLAVALSEFIPASEDLKGVLGLISGPGYKSATRNLLKGLDTKTAVTQQDLESLKDKATTDSLKCEQNTGSKGQRPYSDAILNGVEAACGFTYLQDGGSARHSEFAVMLDHAARRVSLAHTWVKRAEAERRRFEEDAKKIAKVPTPARNWLDSFCLERSLASGALEPYRIRRRALGGWKEVVAAWAKSSCSSCEDRISEARKLQDDPEIDKFGDIQLFEALAEDDALCVWHKDGYPAKATDPQPLIDYVLATEAEFKKRDFKVPSYRHPDALLHPVFCDFGNSRWDICFEIHKNRQSPNPNALSVTLWTGSEIKPVSLRWQSKRLARDLALDQEAQGNGASEVTRADRLGRAASNVTKNDEVNIAGLFEQKDWNGRLQAPRQQLEAIAAVRDNLSLSAEERNRRMSGMMDHIRWLVTFSAKLQPKGPWLDYATTNDLKLDQKNGEIVATPSNSKNEWRGLAYPFWHSDNQEGRKGLAKHCLSRLPGIRVLSVDLGHRHAAACAVWEAVSAEQVKKACQIAGHEAPKASNLYLHLKRKATKQKKDNQVVIEETTVYRRIGADTLPDGTQHPAPWARLDRQFLIKLQGEEEGVRKASDEEVREVYQLEAEVGRTAPMDADDGEVRKPSLPVDELMSSAGRTMRLALKRHGDRARIAHYLITNEKIKPGGIKEKLDEEGRVDLLLDTLVMWHNLFSFHGWQDDEARQLWDNHVAKLSGYKAPERIGEECSGKSRKNKQQENREKLRDAAKALAKDITLRKALHEAWKKRWEDDDERWKKQLRWFKDWILPRGKHASDPTIRKVGGLSLTRLATLTEFRRKVQVGFFTRLQPDGTKAEIKERFGQSALDALEHLREQRVKQLASRITEAALGIGRMRRPAGGKDPK

SEQ ID NO: 61910 - protein, 625 aa, Unknown
  Microbial source - Accession No. JGI24721J44947_10029740
MLALKLKIMPTEKQAEILDAMFWKWASICSRIAKMKKKVSVKENKKELSKKIPSNSDIWFSKTQLCQAEVDVGDHKKALKNFEKRQESLLDELKYKVKAINEVINDESKREIDPNNPSKFRIKDSTKKGNLNSPKFFTLKKWQKILQENEKRIKKKESTIEKLKRGNIFFNPTKISLHEEEYSINFGSSKLLLNCFYKYNKKSGINSDQLENKFNEFQNGLNIICSPLQPIRGSSKRSFEFIRNSIINFLMYSLYAKLFGIPRSVKALMKSNKDENKLKLEEKLKKKKSSFNKTVKEFEKMIGRKLSDNESKILNDESKKFFEIIKSNNKYIPSEEYLKLLKDISEEIYNSNIDFKPYKYSILIRKPLSKFKSKKLYNLKPTDYKYYLQLSYEPFSKQLIATKTILGIDRGLKHLLAVSVFDPSQNKFVYNKLIKNPVFKWKKRYHDLKRSIRNRERRIRALTGVHIHENQLIKKLKSMKNKINVLYHNVSKNIVDLAKKYESTIVLERLENLKQHGRSKGKRYKKLNYVLSNFDYKKIESLISYKAKKEGVPVSNINPKYTSKTCAKCLLEVNQLSELKNEYNRDSKNSKIGICNIHGQIDADLNAARVIALCYSKNLNEPHFK

SEQ ID NO: 61911 - protein, 1317 aa, Unknown
  Microbial source - Accession No. JGI24721J44947_10039167
  misc_feature (1191)..(1191): Xaa can be any naturally occurring amino acid
  misc_feature (1193)..(1193): Xaa can be any naturally occurring amino acid
MPQQPTTQRAYTLRLRGADPNETSWREALWQTHEAVNKGAKVFGDWLLTLRGGLDHALADTKVKGKKGKPDRDPSAEERKARRILLALSWLSVESKLGAPADFIIASGEETAEARNAKVIAALEEILRSRDVAEEAIGDVTKKPEDQPGTWIGDCAPSLTAAIREDAVWVNRSKAFDEAVKSIGSSLTREEAWDMLERFFGSRDAYLAPAKGSEDESSETEQEDKTKDLVQKAGQWLSSRFGTGKGADFCRMADVYKKIAEWADNAQADTTGNDAINNLAAFLSEFNPASNDLKGVLGLISGPGYKSATRNLLTQIAAKATVTQQDLARLKDTATEDARKCYQNTGSKGQRRYADSILKDVESVCGFTYLQEGGPARHSEFAVILDHAARRVSLAHTWIKRAEAERRKFEEDAKKIGQVPKAAKDWLDQFCLERSGVSGAQEPYRIRRRAVDGWKEVVTAWSKADCKTAEDRIAAARALQDDPEIDKFGDIQLFEALAEDDAVCVWHKDGDAAKTPDPQPLIDYALAAEAEFKKRHFKVPAYRHPDALLHPIFCDFGKSRWDICFDVHKNTKTPFPRTLCLTLWTGSEMVSVPLCWQSKRLARDLALDHGRQDLGSPKVTRADRLGRAASNVTENDEVKIAGLFEQADWNGRLQAPRQQLEAIARYVAKNGWDEKAKKMRDAIQWLVTFSAKLQPNGPWCAYAEEHNLNKDPQYWPHADTNKDRKSHARLILSRLPGLRVLSVDLGHRYAAACAVWEALSDKAFKEDLEGKKIIRGGTSDNSLYCHTEHEVNGKKHITIYRRIGADTLPDGTPHPAPWARLDRQFLIKLQGEEEGVREASNEEIWQVHQMECTLGRKTPLIDRLVAAGWGSTEKQKARLDALKNLGWKPVEKAETSEDADTEEEELSFRPSLSVDELMSSAVRTMRLGLKRHGDRARVAYYLITDEKTKPGGIKEKLDENGRIDLLQDALVIWHDLFSSRGWRDDAAKRLWDENIARLCGYKAPEEIGENASGVERKTKQKENREKLHGVAKALAQDVTLRKALHDAWKKRWEEDDGRWKKQLRWFKDWVLPRGKHASDPTIRKVGGLSLTRLATLTEFRRKVQVGFFTRLHPDGTRAETGEKFGQSALDALEHLREQRVKQLASRIVEAALGIGRMKRPAKGKDPKRPEVRVDEPCHAIVIEDLTHYRPXEXRTRRENRQLMDWASSKVKKYLSEACQLHGLHLREVSAAYTSRQDSRTGAPGIRCEDVPVKDFLNLPFWKKEVKSAESKDDAQSKYFIALCEKASVMTEEEKKKTSFRIPRRGGEIFVSADETSP

SEQ ID NO: 61912 - protein, 430 aa, Unknown
  Microbial source - Accession No. JGI26463J51803_1000081
MGRVNRYRVLREAQGFRALRILADRVSRLWNAAQFLSRQRYLAGEPVPSYAELCATFQAHESYKALPSDVAQETLKKVRESWKAYFEALRAYREGRVHNPPGLPGYWKDRKTGHRLVRCIPIKHPRSYRVADGILEIPLPPDLRGPEGTRLRLRIRGAKRWHGKEGRLELVWDSARRAWYASQSVEVQCTAHTERPRKFAAVDRGARVPVALAVEGSQEAWVFRSRELWKDYRNLAGRIYRLQALLATRGQHTSRKLRRLFGRRRERVLAAYRALARTVVRILQKTKVTDLLVGDLTGIREDMDFGKLNELVHNFWSFRELASALLDACERAGIRVHLVPEQGTSSHCAVCGQNVVRPLRSRVRCPAGHEIHADVNGALNLLYREPEVRARAEGRPRWCTYRWNGHRWVPTESARRSAQDPGSLQAAPAA

SEQ ID NO: 61913 - protein, 1489 aa, Desulfatirhabdium butyrativorans
MPLSNNPPVTQRAYTLRLRGADPSDLSWREALWHTHEAVNKGAKVFGDWLLTLRGGLDHTLADTKVKGGKGKPDRDPTPEERKARRILLALSWLSVESKLGAPSSYIVASGDEPAKDRNDNVVSALEEILQSRKVAKSEIDDWKRDCSASLSAAIRDDAVWVNRSKVFDEAVKSVGSSLTREEAWDMLERFFGSRDAYLTPMKDPEDKSSETEQEDKAKDLVQKAGQWLSSRYGTSEGADFCRMSDIYGKIAAWADNASQGGSSTVDDLVSELRQHFDTKESKATNGLDWIIGLSSYTGHTPNPVHELLRQNTSLNKSHLDDLKKKANTRAESCKSKIGSKGQRPYSDAILNDVESVCGFTYRVDKDGQPVSVADYSKYDVDYKWGTARHYIFAVMLDHAARRISLAHKWIKRAEAERHKFEEDAKRIANVPARAREWLDSFCKERSVTSGAVEPYRIRRRAVDGWKEVVAAWSKSDCKSTEDRIAAARALQDDSEIDKFGDIQLFEALAEDDALCVWHKDGEATNEPDFQPLIDYSLAIEAEFKKRQFKVPAYRHPDELLHPVFCDFGKSRWKINYDVHKNVQAPFYRGLCLTLWTGSEIKPVPLCWQSKRLTRDLALGNNHRNDAASAVTRADRLGRAASNVTKSDMVNITGLFEQADWNGRLQAPRQQLEAIAVVRDNPRLSEQERNLRMCGMIEHIRWLVTFSVKLQPQGPWCAYAEQHGLNTNPQYWPHADTNRDRKVHARLILPRLPGLRVLSVDLGHRYAAACAVWEAVNTETVKEACQNVGRDMPKEHDLYLHIKVKKQGIGKQTEVDKTTIYRRIGADTLPDGRPHPAPWARLDRQFLIKLQGEEKDAREASNEEIWALHQMECKLDRTKPLIDRLIASGWGLLKRQMARLDALKELGWIPAPDSSENLSREDGEAKDYRESLAVDDLMFSAVRTLRLALQRHGNRARIAYYLISEVKIRPGGIQEKLDENGRIDLLQDALALWHELFSSPGWRDEAAKQLWDSRIATLAGYKAPEENGDNVSDVAYRKKQQVYREQLRNVAKTLSGDVITCKELSDAWKERWEDEDQRWKKLLRWFKDWVLPSGTQANNATIRNVGGLSLSRLATITEFRRKVQVGFFTRLRPDGTRHEIGEQFGQKTLDALELLREQRVKQLASRIAEAALGIGSEGGKGWDGGKRPRQRINDSRFAPCHAVVIENLANYRPDETRTRLENRRLMTWSASKVHKYLSEACQLNGLYLCTVSAWYTSRQDSRTGAPGIRCQDVSVREFMQSPFWRKQVKQAEAKHDENKGDARERFLCELNKTWKAKTPAEWKKAGFVRIPLRGGEIFVSADSKSPSAKGIHADLNAAANIGLRALTDPDWPGKWWYVPCDPVSFESKMDYVKGCAAVKVGQPLRQPAQTNADGAASKIRKGKKNRTAGTSKEKVYLWRDISAFPLESNEIGEWKETSAYQNDVQYRVIRMLKEHIKSLDNRTGDNVEG

SEQ ID NO: 61914 - protein, 1142 aa, Tuberibacillus calidus
MNIHLKELIRMATKSFILKMKTKNNPQLRLSLWKTHELFNFGVAYYMDLLSLFRQKDLYMHNDEDPDHPVVLKKEEIQERLWMKVRETQQKNGFHGEVSKDEVLETLRALYEELVPSAVGKSGEANQISNKYLYPLTDPASQSGKGTANSGRKPRWKKLKEAGDPSWKDAYEKWEKERQEDPKLKILAALQSFGLIPLFRPFTENDHKAVISVKWMPKSKNQSVRKFDKDMFNQAIERFLSWESWNEKVAEDYEKTVSIYESLQKELKGISTKAFEIMERVEKAYEAHLREITFSNSTYRIGNRAIRGWTEIVKKWMKLDPSAPQGNYLDVVKDYQRRHPRESGDFKLFELLSRPENQAAWREYPEFLPLYVKYRHAEQRMKTAKKQATFTLCDPIRHPLWVRYEERSGTNLNKYRLIMNEKEKVVQFDRLICLNADGHYEEQEDVTVPLAPSQQFDDQIKFSSEDTGKGKHNFSYYHKGINYELKGTLGGARIQFDREHLLRRQGVKAGNVGRIFLNVTLNIEPMQPFSRSGNLQTSVGKALKVYVDGYPKVVNFKPKELTEHIKESEKNTLTLGVESLPTGLRVMSVDLGQRQAAAISIFEVVSEKPDDNKLFYPVKDTDLFAVHRTSFNIKLPGEKRTERRMLEQQKRDQAIRDLSRKLKFLKNVLNMQKLEKTDEREKRVNRWIKDREREEENPVYVQEFEMISKVLYSPHSVWVDQLKSIHRKLEEQLGKEISKWRQSISQGRQGVYGISLKNIEDIEKTRRLLFRWSMRPENPGEVKQLQPGERFAIDQQNHLNHLKDDRIKKLANQIVMTALGYRYDGKRKKWIAKHPACQLVLFEDLSRYAFYDERSRLENRNLMRWSRREIPKQVAQIGGLYGLLVGEVGAQYSSRFHAKSGAPGIRCRVVKEHELYITEGGQKVRNQKFLDSLVENNIIEPDDARRLEPGDLIRDQGGDKFATLDERGELVITHADINAAQNLQKRFWTRTHGLYRIRCESREIKDAVVLVPSDKDQKEKMENLFGIGYLQPFKQENDVYKWVKGEKIKGKKTSSQSDDKELVSEILQEASVMADELKGNRKTLFRDPSGYVFPKDRWYTGGRYFGTLEHLLKRKLAERRLFDGGSSRRGLFNGTDSNTNVE

SEQ ID NO: 61915 - protein, 454 aa, Azospirillum sp.
MAEASPNRTVMRTFKFRLYPTAEQDARMRSWCGAVRAVYNAALQQRQWYGRPAGTDWHRRDCRFNANRQSLDLKHARAEFDCLADCPADILMAGLRDLDKAFQNFFAGRARYPSPRRKHQNESFQFRVFQHRKSETHPFYMLVVFGRDSVKLPKIGRIEWVKHAHIRGEAKTATVVREGDRWFICVAAEIVLTPRPAPGGAVGIDVGVAVPLMTSEGEALAVDRTPPHLEKRRRRLQRELSRCRRGSRRRAKRREKLAVIARRISARRKAQLHQVTTDLASRYGLVAIEDLRVRNMTASAAGTVEQPGCNVKAKAGLNRSLLDVSPGQFRLLLTYKVTARGGMVVAVDPRDTSRTCPACGHVDAENRRSQAEFRCVRCGHEDNADANAARNILRRALATLSSATVSGRRKAPSEPRRRSATPKPSVSPSRAGQPSESQVQPKGMIVPDQLLVPG

SEQ ID NO: 61916 - protein, 1501 aa, Oscillatoriales cyanobacterium
MPQQAKPPVTQRAYTLRLRGADSNDPSWRDALWQTHEAVNRGAQAFGDWLLTLRGGLDHTLADTPVKGGKGKPDPDPTDEERKARRILLALSWLSVESKLGAPAGLIIAFGTEAAEERNRKVVAALEEILKSRGVDQNEINAWKKDCSASLSAAIRDDAVWVNRSKAFDEAVESIGSSGSSGSSLTREEPWDMLERFFGSRDAYLAPAKGSEDESSEAKQEDQAKDLVQKAGQWLSSRFGTGKGADFRRMATVYEAIAKWDGKASLEMAGDKAIADLATALSEFNPASNDLQGVLGLISGPGYKSATRNFLNQLAAQTTVTQQDFVSLKDKANNDAQECKQNTGSKGQRPYSNSILEKVESVCGFTYLQDGGPARHSEFAVILDHAARRVSLAHTWIKLAEAERRKFEEDAKKIDQVPEAAKDWLDRFCLERSGVSGALEPYRIRRRAVDGWKEVVAEWSKSDCKTVEDRIAAARALQDDPEIDKFGDIQLFEALAEDDAVCVWHKDGDAAKAPDPQPLIDYALAAEAEFKKRHFKVPAYRHPDALLHPIFCDFGKSRWDICFDVHKNMQTPFPRALCLTLWTGSEMKRIPLCWQSKRLARDLALGNNTGDAGASEVTRADRLGRAASRAASNVTKSDVVNIAGLFEQADWNGRLQAPRQQLEAIARYVEKHDWDQKAEKMRNAIQWLVTFSARLQPQGPWCAYAKIHGLKEDPQYWPHADTNKNRKGHARLILSRLPGLRVLAVDLGHRYAAACAVWEALSTEAFQREIKGRTILRGRTDGNALYCHTRHKANGKERVTIYRRIGADTLPDGKPHPAPWARLDRQFLIKLQGEEEGVREASNEEIWAVHQLEAALGRPVSLIDRLVASGWGGSDKQKARLEGLKQLGWDPADKPSLSVDELMSSAVRTMRLALKRHGDRARIAHYLITDEKTTPGGIKETLDEKGRIDLLQDALVLWHDLFSSRGWRDDTAKQLWNAHVAKLHGYKAPEEPGEDSSGAERKKKQRENREKLYDVAKALAQDVTLREALHDAWKKRWENDDERWKKQLRWFKDWVFPRGNHASDPTIRKRQLINPSGGNGRRGNHASDPTIRKRQLINPSGGNGRRGNHASDPTIRKVGGLSLPRLATLTEFRRKVQVGFFTRLKPDGTRAETKEQFGQSALDALEHLREQRVKQLASRIAEAALGVGRVRRPVEGKDPKRPDVRVDEPCHAIVIEDLTHYRPEETRTRRENRQLMTWSSSKVKKYLAEACQLHGLHLREVSASYTSRQDSRTGAPGVRCQDVPVKEFMRSPFWRKQVKQAEAKQAANKGDARERLLCDLNARWKDRTAADWEKAGAVRIPLQGGEIFVSADANSPAAKGIQADLNAAANIGLRALTDPDWAGKWWYVPCDPASFRPVRDKVDGSAVVNPDQPLRQSAQAQSGDAAKDKNGNKGAGKSKEVVNLWRDISSSPLECIEFGEWKEYAAYQNEVQCRVIRILKEQIKGRDKQPHEGSKEDDIPL

SEQ ID NO: 61917 - protein, 1188 aa, Unknown
  Microbial source - Accession No. 49155357
MPQQDKPPVTRRAYTLRLRGTDPSNTSWRKALWQTHEGVNKGAKKFGDWLLTLRGGLDHTLADAKVKVGKGKPDRDRTDEERKARRILLALSWLSVESKIGAPVGHIIASGEEVAEDRNSKVVAALEEILKSRDLANNEIEEWKNDCSASLSAAIRDDAVWVNRSKAFDDAVKSTVGCSLTREEAWDMLERFFGSRDAYLAPVKISEDESSEAEQEDKAKDLVQKAGQWLSSRFGTGKGADFSHMAKVYERIAAWTDNAQVGTTGNEAINNLAVALSEFIPASEDLEGVLGLISGPGYKSATRNLLKGLDTKAAVTQQDLENLKDKATTDSQKCEQNTGSKGQRPYSDAILNGVEAACGFTYLQDGGSARHSEFAVMLDHAARRVSLAHTWVKRAEAERRRFEEDAKKIAKVSTPAKNWLKSLEVERSLTSGALEPYRIRRRALGGWKEVVAAWAKSSCTSYEDRISEARKLQDDPEIDKFGDIQLFEALAEDDALCVWHKDGDPAKATDPQPLIDYVLATEAEFKKRNFKVPSYRHPDALLHPVFCDFGNSRWDICFEIHKNRQSLNPNALSVTLWTGSEIKPVSLRWQSKRLARDLALDQEAQGNGASEVTRADRLGRAASNVTKNDEVNIAGLFEQKDWNGRLQAPRQQLEAIAAVRDNLSLPSEERDRRMSGMMDRIRWLVTFSAKLQPKGPWCEFAEKLHLKIDPQYWPHADINKNRKGLARLMLSRLPGLRVLSVDLGHRHAAACAVWEAVSAEQVEKACRIAGHESPKASDLYLHLKRKATKQKKGNQVVVEETTVYRRIGADTLPDGTQHPAPWARLDRQFLIKLQGEEEGVRKASNEEIWKVYQLEAEVGRTAPIIDRLFKAGWGRSGQQRVRLEALRELGWRPASEAEISDDMDAEEGEVRKPSLSVGELMSSFVHTMRLALKRHGDRARIAHYLITDEKIKPGGIKEKLDTEGRVDLLLDALVMWHNLFSFHGWRDDEARQLWDKHVAKLSGYKAPERISEECSGKSRKNKQRENREKLRDAAKALAKDITLRKALHEAWKKRWEDDDERWKKQLRWFKDWILPRGKHANDPTIRKVGGLSLTRLATLTEFRRKIQIGFFTRLKPDGTRAEIKERFGQSTLDALEHLREQRVKQLASRITEAALGIGRMRRPAGGKDPKRPGVSVDEPCHACCRNLL

SEQ ID NO: 61918 - protein, 449 aa, Candidatus Staskawiczbacteria
MAKGEKNNDVLYRAVKFEIRPTLNQETILQRISSNLRLIWNEAWKERQDRYEIFFKPIYERIYNAKKKALEKGFTDLWEKEVAKFSQQVLVKRGFPLQLVLEQKSLFAELKKAFEEHGITLYDQINALTAKRSLNTEFGLIPRNWQEETLDALDGSFKSFFALRKRGDKDAKPPSERTNEDSFYKIPGRSGFKVTDDGKVIVSFGKLSETLVGRIPEYQQEKLSHAKNLKKFEIVRDERDMAKSGCFWISIAYEIPKPPELPFNPSKAVFLAIGASWIGIISPRGEFCWRMPRPDFHWKPKINAVDERLKRVSKGSIKWKRLIFARSKMFAIMARQQKQHGQYEVIKRLLELGVCFVVTDLKVRSKEGSLADSSKAERGGSPFGANWSAQNTGNIANLVAKLTDHVSALGGMVIKRKSPELLVEEKRLPQEKRKILLAQKLKDEFLSLN

SEQ ID NO: 61919 - protein, 352 aa, Candidatus Staskawiczbacteria bacterium
MQLVSEKESLLQELSIAFQEHGVTLYDQINGLTARRIIGEFALIPRNWQEETLDSLDGSFKSFLALRKNGDPDAKPPRQRVSENSFYKIPGRSGFKVSNGQIYLSFGKIGQTLTSVIPEFQLKRLETAIKLKKFELCRDERDMAKPGRFWISVAYEIPKPEKVPVVSKQITYLAIGASRLGVVSPKGEFCLNLPRSDYHWKPQINALQERLEGVVKGSRKWKKRMAACTRMFAKLGHQQKQHGQYEVVKKLLRHGVHFVVTELKVRSKPGALADASKSDRKGSPTGPNWSAQNTGNIARLIQKLTDKASEHGGTVIKRNPPLLSLEERQLPDAQRKIFIAKKLREEFLADQK

SEQ ID NO: 61920 - protein, 1152 aa, Unknown
  MTKY01071110.1_o | Anaerobic digester metagenome soeholt_digester_71110
LALSWLSVESKLGAPAGFIIASGTEAAEDRNGKVVAALEEILKSRNLAENEIDEWKNDCSASLTAAIRDDAVWVNRSRAFDDAVESVGCSLTREEAWDMLERFFGSRDAYLAPAKVTEDESSEEEQEEKAKDLVQKAGQWLSSRFGTGKGADFSRMAAVYGKIAAWADNAQAGTTGNQAINKLAADLSEFTPASNDLQGVLGLISGPGYKSATRNLLNGLATKTTVTQQDFGSLRDKAADDAQKCKQNTGSKGQRPYSDAILKDVEAVCGFTYLQQDGGAARHSEFAVILDHAARRVSLAHTWIKRAEAERRRFEEDTQRLANVPGPVKAWLDSFCSERSATSGALEPYRIRRRAVDGWKEVVTAWSKSSCSTSADRIAAARALQDDPEIDKFGDIQLFEALAEDDAVCVWHKDGDAAKAPDPQSLIDYALAAEAEFKKRHFKVPAYRHPDALLHPIFCDFGKSRWDICFDVHKNVQTPFPRALCLTLWTGSGMVSVPLCWQSKRLARDLAIGSNATNAGYVEVARADRLGRAASNVTKSDEVKISGLFEQADWNGRLQAPRQQLEAIAVVRDNLSLSAQERERRMSSMKDRIRWLVTFSAKLQPQGPWCEFAKTNQLRIDPQYWPHADSNKTRKGQARLILSRLPGLRVLSVDLGHRYAAACAVWEAVNAEQVKKACQVAGHEAPKASDLYLHLKRKATKRKKGNQVVVEETTIYRRIGADTLPDGTQHPAPWARLDRQFLIKLQGEEEGVREASNEEVLKVYHLEAELGRTAPIIDRLVKAGWGQSGKQRTRLEALRELGWKPASEAVVSDGMGADEGEVRKPSLSVDELMSSAVRTMRLALKRHGDRARIAHYLITDEKTRPGGVKEKLNENGRIDLLQDALLMWHDLFSSRGWRDDVARQLWDNHVAKLSGYKAPEEIGEESSGPERKKRQKENREKLHDVAKALAQDVTLREALHDAWKKRWKDDDERWKKQLRWFKDWVLPRGKHASDPAIRKVGGLSLPRLATLTEFRRKVQVGFFTRLQPDGTRAETKEQFGQSALDALEHLREQRVKQLASRIAEAALGIGRMRRPMGGKDPKRPNGRVDEPCHAIVIEDLTHYRPEETRTRRENRQLMTWSSSKVKKYLAEACQLHGLHLREVSASYTSRQD

SEQ ID NO: 61921 - protein, 412 aa, Microcystis aeruginosa
MKLVQRHLIKFNKKNYLAFDKLAFLSKNLYNCAVYLNRQAFFSHQPFLTMTELHHALKTSADYQALPAKVSQLVLKQVEKTFKSYQKAEEQFKKSPNKFTGEPKLPRYKDKKKGRNVLTYNYQAISKKALKQGLIKLSGTNLEFKTNLKEVLEVRIIPKSGAYYLEIVYEQPSPPSQEGERYAFVDLGLNNLAAVTSNIPEFQPTLLCGKALKSCNQKYNKTLAKLKSELPSLQKTSKRIQGLTLKRNCQVDYYLHTASRYIIDKLLAHQINLLVIGQNQGWKQNLNIGDRNNQSFVNIPHSRFIEQLTYKAILVGIKVITTNESYTSKCSFLDLEPIGKQEKYLGKRVKRGLFRSSSGYLYGADINGSLNIGRKVVGEVAFSKNPIERLVVSPVRVKAYKADSKCDVCVQN

SEQ ID NO: 61922 - protein, 421 aa, Unknown
  NICF_comb_assmDRAFT_10010420 | GENOME_ACCESSION
MFTKVMRYQIVKPIDVDWDIFGHILRELQHETRIALNKTIQLAWEYHGFSSEYKEKFGKSPNNREVLGYTYLHGYAYDRIKSECWKLSTSNLTQTVKRAADKWRADLPEIIRGEKSIPSFRRDVPIDIVSQSLDISKEEDDYFLDISLISTQYRKQLGRKTGKFRVLIHTGEKSKRAILDRLIDGTYKLGVSQILYHKKKWFINITYQFEGKSLPLDPDTIMGVDLGVTNAVYMAFNNSLHRYKIVGGEIEQFRKQIERRRRELLIQSKYAGEGRSGHGTKTKIAPIEVLEKKAANFKSTVNHKYARYIVNMALKHRCGTIQLEDLSGIREENTFLANWPYHDLQQKIEYKAKEVGIRVVKINPEFTSQRCSRCGHISKENRPDQATFECTKCGLKTNADFNAAKNIATRGIEDLIRQAKS

SEQ ID NO: 61923 - protein, 480 aa, Archaeoglobales archaeon
LQPDKLEREQAIKITVKGVISPRDEGIRTLLQEYKVYKKVLISRISESIKTVIKDKNIRVYSLQKYLLQKKIIEYLKNLPYHPMPYGNQSYWIEERDGKFLIHIKTKNGESVCYLQVPNKYRTLMKKASGKVCPHMNEGKCEFTICPFKTSKMCNKINPYRGEMKLIEDKKYGWINCHITLRLPKPEPYEPKGWIGVDVGWNYLAVSAYVSNEGKISHVTFHGKEWKTRIIQLKYLLKMFQRTGKSTKVWRHRLRNVTNYTVGVIAKEIVRKAKKLKAGVAVEKLTFQAHTKRWLIPRYKLRCAIKNLCERKGIPFVEVSAKNTSIKCNKCGYIDEKNRNGKIFKCLKCKYTCNADFNAAVNIAKKAIEKYKKEKLKAAGKTAIPASYTDAGKDPHAKMTHPQKDVDGVAGRGMLRAPKAPMTNDQPIDDPYKREGNPSIIEDHTQRKAIKTTKQQKLTKYLHLQKQQKITKNRSRKTIE

SEQ ID NO: 61924 - protein, 505 aa, Unknown
  Microbial Source - OGCG01005283.1_o | hot springs metagenome genome assembly
MNTDSKRVLIVRLNPTRDEQIYLISLIKAYTSIAKKLHTDAYAKFKELTANGVIENIKQLKDVKKKFYSWYNEYFKTQRKWITDALGSNVTDQLFQFLRGQYENFFANYENFFKHKIEGRPSFPNLPELFQIRDRGVAIDFDRKILTIKLKGKRLSLRFQADRLLYRGEPGSVTIKQQDGRFYAYIPFDFTPKFEEGKKGAIDIGLVNFFATVTEDGDVILVKAKEYAYVYKKYKEKIKELDRLIGKIKKHILRMYFTPPKSFRRYPFLGFTNNRQVSKIITSLYTSWYDVGRAKKKRLRREDMTSIVKKIRKVDYRLRITKLNFVKSDGSVKLFPKKSPFVRDVYKDLPILHKLEYEKKKLFEKRDRTLTHIRRTAINALLRILRERGVTHVVVGHPYNINKNRNELTVNLFQYRKTINDLKIIGERYGIKVDEIVEYNTSIRCSICGEVHKNGRIERGLYRCEKTGKVINADVNSALNIFYKAFSKMPKQLKKIETIKLHFFT

SEQ ID NO: 61925 - protein, 537 aa, Unknown
  Microbial Source OGCG01007631.1_o | hot springs metagenome genome assembly
VPAKTPSDKNNGKQSRKKENDNKRALTVKLNPTRDDQIYLTSLIKTYTAIANKLNKDAFAKFKELTSNGEIRNIADLKDIKKEFNWWFNEYYKTQRRWITDNLGSNIADQLFKFLTAQYSNFFANYENFFKHKMEGRPSFPSLPELFQIRDRGVEVDFDKKILIIKLKGKQLRLKFQSDRLLYQGDPGSVTIKKVDGKFYAYIPFDFNPKIEEGKKAAIDIGLVNFLATVTEDGDVILVKAKQYTYTYSKYKDRIKELDRMIGNIRKHTLKMYVYPPKSFTYYHFLGFTNDRRIRKIIISLYTSRYDDKRGKKKKLTREDMTNIVKEIHKVNYRLRVRRLNFMKTIGHIKLFPKKSRYMNDVFQDLPILHKLEYERRKLYEKRDRTLRHIRRTAINALLRILKQRGVTHIVVGYPRYINKNRNELTVNLFQYRKTINDLKIIGQRYGMKVEELEEYGTSITCSICGQEHKSGRIERGLYKCEKTGKTINADVNGALNIFYKAFSKMPKQLKKTETIKLTFTPLQRNVTLSPLYYRKL

SEQ ID NO: 61926 - protein, 413 aa, Unknown
  Microbial source - OKRQ01000045.1_o | freshwater metagenome genome assembly
MMKLVQKHLIKFNHKNYSVIDKLGFLSKNLYNCAVYLNRQVFFSHQPFLTMTELHHALKMSPDYQALPAKVSQLVLKQVEKTFKSYQKAKEQYKKSPDKFTGEPKLPRYKDKEKGRNVLTYNYQAISQKALKQGLIKLSGTNLEFKTNLKEVLEVRIIPKLGAYCLEIVYEQPSSSSQEGERYAFIDLGLNNLAAVTSNIPEFQPTLVCGKALKSCNQKYNKTLAKLKSELPSLQKTSKRIQGLTLKRNCQVDYYLHTASKYIIDKLLAHQINLLVIGHNQGWKQNINIGDRNNQSFVNIPHSRFIEQLTYKANLVGIEVKTTNESYTSKCSFLDLESIQKQKSYLGKRIKRGLFRSSSGYFYGADINGSLNIGRKVVGEAAFSGNPIERFVVNPVRVKAYKANSRCNICVQN

SEQ ID NO: 61927 - protein, 1592 aa, Unknown
  Microbial Source - OQOO01000421.1_o | human oral metagenome genome assembly
RSTLFPYTTLFRSGRREVRRRLNERSRALTSRILNALRRVHQRPKHRAGLPRAAKRRQLRDDRHDRERNRQRAARGGRRNSRRNPAEASSGRRREHVEEQLPHGMRDVDTTKGQERVGMFDRRIGRRLTMPKQDKPSVTQRAYTLRLRGADPSDTSWRDALWRTHEAVNKSAKAFGDWLLTLRGGLDHTLADARVKGGKGKPDRDPADAERKARRILLALSWLSVESKLGAPEGYIVASGEEAPENRNGKVVAALEEILKNRNLADNEIGEWKKDCSSSLSAAIRGDAVWVNRSKAFDEAVKSIGCSLTRDEVWDMLERFFGSRDAYLAPAKGSEDESSETEQGNKAKDLVQKAGQWLSSRFGTGKGADFCRMADVYGKIAAWAGANKSNGSATVDDLAKELQKELQIEESKATDGLDWIIKLSSYPGHSPNPVHELLRQNPKLARSNLDDLEKTANTRAESCRSKIGSKGQRPYSDAVLKDVEAVCEFTYLQKDGPARHSEFTVILDHAARRVSLAHTWIKRAEKERSKFEEDAKKIGQVPKAAKDWLHKFCTERSQASGALEPYRIRRRAVDGWKEVVAAWSERSCNTSADRIAAARALQDDPEIDKFGDIQLFEALAEDDAACVWHKDGDAAKAPDPQPLIDYALAAEAEFRKRHFKVPAYRHPDALLHPVFTDFGESRWKICFDVHENLETASPHALSLKLWTGSEVVPVPLRWQSKRLARDLALGQDAQKDGALEVARADRLGRAASNVTKSDEVKISGLFEQADWNGRLQAPRRQLEAIAVVRDNLSLSDQERERRMSGMMDRIRWLVTFSAKLQPQGPWYEFAKTNQLRIDLQDWPHADSNKTRKGHARLILSRLPGLRVLSVDLGHRYAAACAVWEAVNAEQVEEACKDAGHEAPNANDLYLHLKRKATKKQKKDKKIEVEKTTIYRRIGADTLPNGTPHPAPWARLDRQFLIKLQGEKEGVREASNEEVWKVHQLETELGRTTPLIDRLVASRWGGSDKQIARLEELKKLGWNSAEKSDPNGESDEGESRRPSLSVDELMSSAVRTMRLALKRHGDRARIAHYLITDEKTKPGGTKEKLDESGRVDLLQDALVMWHDLFSSHGWEDKAAGQLWGEHVAKLSEYKAPEEIDEGSSVIERKKKQKENREKLYDVAEALAQDETLRKALHDAWKKRWEEDDEQWKKRLRWFKDWILPRGKAANDPAIRKVGGLSLPRLATLTEFRRKVQVGFFTRLHPDGTRAEAKEQFGQKTLDALEHLREQRVKQLASRITEAALGIGSEGGKGWDGGKRPRQRIDDPRFAPCHAIVIEDLTRYRPEETRTRRENRQLMSWSSSKVKKYLAEACQLHGLHLREVSASYTSRQDSRTGAPGIRCQDVPVDEFMRSPFWRHQIAQAEKKQSGGKGDARERFLCDLNARWKDKSEADWKKAGAVRVPLKGGEIFVSADPASLAAKGLQADLNAAANIGLRALIDPDWPGKWWYVPCDPVSFRPIKDKVAGSAAVKLDQALRQPAQAQSGDAKAKKKREKKDAGKPQEVVNLWRDISSSPLGESGEWKEYAAYRNQVQVRVVDILRRAVCSKNNREKQ

SEQ ID NO: 61928 - protein, 521 aa, Unknown
  Microbial Source - OQUW01.1 | hot springs metagenome genome assembly
MKTFKVKLYPTESQSRRMEQWLITLQRHYNRVLAITLWTQRRYNLPVSKSICGGLKTPKKDGDKRPYIYGIYVAAKRRNQFLNDIPADTVNQTIQSRIEAAFDKWAAACKGKKGEDFFKGQPKFANRDRFTSFQFRTRPPRPLFTYDHKGRRYLNIPNAQGADKIGPILCSLSPDTPSDFTKSFCAIQREPDGWYACIVINLENQVRWDKAPHGVVGIDVNIGSIDLSDGTRIPMPFFADRYRDEVLRLTQKLARTRRENKDWRSSKRYADAKKRKAVLEARITRERKAWHANVVAWLVSRYDRIYVENLEPKNMVKNKHLAKAISSQAWGHFFEMLEMKCAEHGRIFGRVPPSYTSKTCSSCGWVNKAKPGEKGYMGLHVRQWVCPECQTHHNRDVNAAKNICAKGEEAFATGNYEKQELGKRKAKSNSKVLLTERTEAKAGTIIIPCPTLDLPTPPNLPAHKRRSKAEWSAKQRAERARRRNKNAKKEKLTSVDLNGQKKNFNGRKEKLANSTQLSLFC

SEQ ID NO: 61929 - protein, 1434 aa, Unknown
  Microbial Source - OQUW01000094.1_o | hot springs metagenome genome assembly
MDKQVAVTQRAYTLRLQGADPQDQSWREALWQTHEAVNKGARAFGDWLLTLRGGLDHTLADAKVKGGKGKPDRDPTNEERRDRRILLALSWLSVESAPKDGDTRKPFVTATGQDSQAIREEKVLCALRGILEKRGVRGADLEGWIKDCTPSLSAAIRDDAVWVNRSEAFDKAVDSIGSSLTRDEVWDMLERFFGSRQAYLAPAEGAEDESAEAEQEDKAKDLVQKAGQWLSSRFGTGKGADFSRMAAVYEKIADWAGKARAGMTGDAAVAGLAAALSEFSPASNDLQGVLRLISGPGYKSATRNLLNQFAARPSVAQEDLENLRDSACDDAEKCKANTGSKGQRAYADAILKDVESVCGFTYLQDGGPARHSEFAVMLDHAARRVSLAHTWIKRAEAERRRFEEDARRMDKVPASVKAWLDGFCLERSEASGALEPYRIRRRAVDGWKELVAAWSNADCRTAEDRIAAARALQDDPEIEKFGDIQLFEALADDEALRVWHKDGDSAKAPDPQLLIDYVLATDAEFKKRQFKVPAYRHPDALLHPVFCDFGNSRWDISFDVHEAVKTGGRNRKNMMVPQDPHALSMTLWTGSTVEPQRLRWQSKRLARDLALKGRQGSNAPEVTRADRLGRAAADVPARATVRIAGVFEQEDWNGRLQAPRAQLDAIAARVARHGWDDKARQMRDHLRWLITFSAKLQPSGPWLDYAAAFPDDAPAKPFVSRKGGYAVRHQDNDAREGHAKLSLSRLPGLRVLCVDLGHRYAAACAVWETLSATQVGDACRAAGREPPRDSDLYLHLKKKVKKQKKGTEVEVEETTIYRRIGADILPDGKPHPAPWARLDRQFLIKLQGEDREARKAGPAELEAVQRVEKEVGREPPDQRALRVDELMSETVRTVRLALQRHGRRARIAFNLTAHKKLLPGGREEVLTAEERVGLLADTLADWYALFTGKGWNDHWARQQWEAHITPLLQGAALPQMPHDAEDMPKARREYEADLMKRLSPVAKSLAGNESLRRQLHCLWATRWRDDDVTLQKCLRRLRDWILPRGRKAKADGAIRHVGGLSLTRIATIKSLYQVQKAFYMRPQPQDLRKNIPSKGDDALVGFGRRILDAMEHMREQRVKQLASRIAEAALGIGRVKRLAGGKDPKRPRQRVDRPCHAVVIENLTHYRPEETRTRRENRQLMSWSSSKVRKYLAEACQLHGLHLREVQAGYTSRQDSRTGAPGVRCQDVPVKQFMQSPFWRKQVAQAEKKRAEGKGDARERFLCDLNAKWNDKLEADWEKAGAVRIPLKGGEIFVSADRDSPAAKGLQADLNAAANIGLKALLDPDWPGRWWYVPCDPATFKPAEDKVAGSAAICLDKPLKNASVAQSTDRRVKKGGKTEARSREVVNLWRDVSSQPISADDNWREFAPYWNDVQARVVRILRQSAGLATDQEER

SEQ ID NO: 61930 - protein, 1256 aa, Unknown
  Microbial Source - OQUW01000235.1_o | hot springs metagenome genome assembly
MTKRKSSLAGYRLHRERILFSGGQVIRTIKFPLTPLNPSKETALFLKDFEKAIIADDLKIRGDLNINDYFVYTAKWKPPYTLFDFWVDSLRAGVIWMPKVTKLIDFLTSQYNITSPFDMVWEKASHRIAVIFQKDKFKDIFLSAPIRNTSTRNSFYERILKSLKDDLVRKNDIISTDAKKEVDLIVNSFFNDDGKLILKGKDQLDFWKREYNLDRSTIESLKPKGAYTDITFVNIPELMHNLDAKQSFEELINKREIWISDKKLLSSILGLSDNFNGFSNYLGVVLKGLQKKDGDIEALYEAQKTIFPRLGNYEDEILNALDFLSQKAKLLGETSLPLVNGWHDYRSVFGGKLQSWFTNSQNRKKELNGQISQFREGLSQVKNYLQKGNFGEEADKEKKDILSFLSLLENFFTDEQKSIKVEVNYQLFESLLALIRRRLNFFYQKYIQKEGNETKVNKYKEFEGLYKTIYKPVAFYGYTAKRANEKFVNKTIPILEDGVENTIKLISYLRDSFSVQKTFESVKQEKEKVDDLYRKFLQFFWNKYVDASINSRLFLEKYEKIIKENIEDSKWKEISDKNRKGRYVFYKSPYAKGSLEKIQIKTNDYLQQLQASVLELAEFILSFKKDTLLSDAILLLDWIELSKNTISLLIRFNTKETYKLDGLLLDIFSQAKRYKELFRRENYPRNEFSFIIQSLILSEIRGAATLYSKKEYIASYSVQVIGADDRYKLYYIPKKEISINADTIKSKPSSIERKQLMKSHNFAIALDKVYEKNKNKTFNAILLSKSGITAVYLPSESLQKLFRLSSSPYQLQFLDKYIYLPDGWENIDISLSEWSFIVEKRYKIDWDLQTKKPTLLPITGSEQAKKNKIYLAIPFNLIPNKQAVQSAPLKVIAKGKETIEKDFSRLNFPILGIDVGEYGIAYCLVRFIFDKNTYKITGVELGSYKEEILGFIEDKNIGNIKDKFAEIQQKARQGAFDEEDNVVARIRENAIGHLRNKIHVIVTQEKSSSVYEDSITNFETGSGRTTKIYNSVKRADTESNTEADKQIHNHVWGEKTKWIGRNIGAYASSYTCLSCLKSLYQIKKEDLAKMIINQKEGRVVTISSRHGNIKGYVSKEEKYDMGYQFKGTDEDLKKIRKIVQDFARPPVTNHSEVLEKYAKKILETGRIEEWRKSRGNSSIFVCPFCQYVADADKQAAFMMAVRGYLRFSGIVPSQSSKKKQGQEEEKTTGESFLEQTQKQLKDIDRSGIKNAFSVRI

SEQ ID NO: 61931 - protein, 1518 aa, Unknown
  Microbial Source - OQUW01001775.1_o | hot springs metagenome genome assembly
MTELQTQRAYTLRLKGIDEKDQSWRDALWKTHEAVNKGAKVFGDWLLTLRGGLDHTLADAEIPGEKGKPDRAPTQEERKHRRILLALSWLSVESERGAPEEFIVATGKEPAATRNDKVIAALKDILRGRNLTEEKISEWTEVCTPSLSAAIREDAVWVNRSRAFDEAVKRIGSSLTREEVWDMLECFFGSRNAYLAPVKISEDESSDGEQEEKAKDLVQKAGQWLSSRFGTGEGADFAKMAAVYAKIAAWAGNAQAGTTGNEVINNLATALREFTPKSNDLKGVLDLISGPGYKSATRNLLKQIANTKTVTREDISKLQETAGEDSEECATKTGSKGKRAYADAILKDVESVCGFTYRIDKDGQPVSVADYSKYDEDYKWGSSRHKEFAVMLDHAARRVSLAHTWIKRAEAERRKFEEDSKKIMQVPQAAKDWLDAYCAQRSEASGALEPYRIRKRAIQGWKEIIASWNKPDCKTAEDRIAAARQLQDDPEIEKFGDIQLFEALAEDDAQCVWKKEDGTLDPEILINYTLASEAMFKKQHFKVPSYRHPDAFLYPVFCDFGNSRWELDFSIREAATKLKEIEAKIEKQRQEVHKVQQALEKCENDEKRPKMEERLKEAQKKLQESQNYGEYLHSNNKITMVLFDGTFVKKHIFAWQSKRLTKDLALYQEPSADPKNVVSRADRLGRAVASVGINDAVKVAGLFEQENWNGRLQAPRQQLEAIAQYVEKHGWDNKAEKMRASIKWFITFSAKLQSKGPWNEFARKHGLKEDPHYWPHAEKNENRTAHSRLILSRLPGLRVLSVDLGHRYAAACAVWEALGSEAFKKDIEGKRIIRGDTDENALYCHTEHEANGKKHITIYRRIGADTLPDGAHHPAPWARLDRQFLIKLQGEDEQAREASNEEIWKVHQLENTLGRRTPLIDRLIAGGWGYTEKQKARLEVLTNLGWCPTNKTDNQEEGDEEETAILSKPSLLVDDLMFSAVRTLRLALKRHGDRARIAHYLITDEKTKPGGVKEKLDKNGRVELLLDALGLWHDLFSSPGWHDEKAKQLWNAYIAGLLPEGELQQAKSVTTSAALGGQQKKEKKEKLRAVAEALYLNSDLCHSLNEVWRKRWEEDDKQWRIYIRWFKDWIMPRGANAKSPAIRHVGGLSLTRLATLTEFRRKVQVGFFTRLHPDGTKTETREDFGQKTLDTLEHLREQRVKQLASRIVEAALGIGSEDKRHWDGKKRPRQRIADPRFVPCHAVVIENLTHYRPEETRTRRENRQIMEWASSKVKKYLSEICQLHGLHLREVSAAYTSHQDSRTGAPGIRCQDVSLIEFMKSPFWRKQVAQAEKKQKEGKGDAVERYLCELNQKWKGASEEEWRKAGFVRIPLRGGEIFVSAAGHDSPAAKGIHADLNAAANIGLRALLDPDWSGKWWYVPCNSSTMCPARDKVTGSAAVNPGQPLQVSAQLESDDAAKDTKKRKKKGDGKSKEIINLWRDISSYPLEDTRGGTWSNKTVYWNRVQSNVVHILQNQMKG

SEQ ID NO: 61932 - protein, 383 aa, Unknown
  Microbial Source - ORXB01007227.1_o | sediment metagenome genome assembly
METVKLCVKGVISPRDAGLRKLMREYVNYKKILIPKVQQAVRQVIKDRGISVYAQQKWMVDKKLSEYLKNLPLHPMPFHNQSVFIEHKDGRFRIHFKTKKEEAICRLSVPAKYHDLIKRACGKDNPVLGQVELMEDRKYGWVNCHIVLRLPRPEPYAPKWWMGVDVGWNKLATSILATANPHLTFSHPTVHGKDFKTRIIQLRHLLKDYARKGKAWKKWDFRLKNTIKYAVGTVAKEIVAKAERHRAGVVMENLTFKSQTKRWLIPRYKLMVAVKTLCKIRGIPFRLVAAKNTSISCPKCGCINAKNRSGERFNCKSCGYQADADITASMNIAKEAIDMGLAPMSTEAADLSAASGDVATPLSADEPMTFIKAGANPRKLKMR

SEQ ID NO: 61933 - protein, 681 aa, Unknown
  Microbial Source - OVXJ01001238.1_o | sediment metagenome genome assembly
LKLTKTILKLELKGDPTSLNSLNDLFNKYDQLVKIADSFIYNVYPIYVSAEQKSLKRLRLKDLVESLDKKAIRKNKRRKERNGIEGEDQQEQDKHKYTCSDLLKTLLHRFIKYADKYYGIDIKYAYLEMQSGLADLMHSNAENAYRFRTLPVLRKLSDTMPIRVSKRPLQENRKNNNDKYYQRTGEFIINGSNIIFRIGGKRNGLYFPIALSFNDAERLKMLSDAIQGNNGLTIGDPCYLVRKRVKGGNSYRYYIQVSVSKNVDKRTIEEAIKNKSVIRIVGVDLGLSKYIATLFCIEVDKANKTYKLIDALGIEGTKEYINAIRKYEEEKKRLQQGKMRGKANSAKISRYKDSEDYTIKNANGDSKRIDLRRQQIGYLCNQIIKFADKNKADIIVVEELKGLNRRLKDLKKIKKVLGKLYNDVNSNGIKSIDEYIKNEAKGKTKDILEILNKIKEYANNHNHNHNHNIRKVTKYILKQRDRIEKRIFLLSVFAYYQFKNELETEALWHDKLLYEVKPSYTSQQCLACRNIDKLNRLTQRQFRCIKCNFKMNADFNASANIALRYVEKLLKIELIPMRNNNDNNDNSSSSSSKQGKGSGTMTITSATTPLHASINASSKAGVVCNNTDGIVAHTMSNVTSTLQGNGEGRPLRVRGQTELPCSVRRLVTLDEFIYEKRGNGG

SEQ ID NO: 61934 - protein, 512 aa, Thermodesulfobacteria bacterium
MITLQTRLQIENKEDLEKLYNLMRRYCSAYRYAYNRLLEKKKETDIRKEIQNLFNINSQYAQSAIWEAKALIRSCKERGQNPKKVIFGGRLLFEKLSKKHLTGKRRRKLKEKWKEKRQKVLYTVGGKYKKGNTNLRLIKNDDNWYLRINVGKKEWIYAKIIRKVKREKDKWIDFIRNLETAENSKGSYAERYFPYTVRVLSKNGKLYAHISYEEKVPEKFKIIKENGIIGIDVNASPFHLALAISSKDGNLLDYKKISLHELINANKNKRKYLEWLIAHEVINYALENNKAIAIEKLEGLKNEKRGSGRAKFRKRLQQFCYRNILEKIKILAKREGIEIIEVNPFYTSVIGKLKYSPIYNIDKDTSAAFVIARRALGFREEIPKNYEKLINDEDYLSYAITELEEKVEEIKKKKNKEKNKYKRNAIKTELKKLKNELNLLKKHLENLKSGKCKPATNNLLIGRNRGVSFQACKAGKYFPQPSLSLTLKNSYKLIVFVGIFLPNQFQGTGGQI

SEQ ID NO: 61935 - protein, 907 aa, Unknown
  Microbial Source - UOVV01006324.1_o | compost metagenome genome assembly
VLGDALNFYYDNVMHPGYEMEYKSANERKKKKLEEEKQAFIQQDYLSIGQLQDALDKYIPEIDDSVDWKRNYTTSCIADYFKNHFNAEKKEGEEKEFTLPANISAKYSCVKGLLENYPKDRELYQDKKAIDNIKLFLDALLELLHFIKPLILRADIALEKDAAFYGQLEPWYDSLKELIPLYNKVRNYATQKPYSIEKFKLNFENSTLLDGWDVNKEKDNSGVLFIKDGHYYLGIMDKKHNKIFRDIPKATSERTYRKINYKLLPGASKMLPKVFFSDKNTSYFSPDEEIQRIRNHGTHTKNGDPQEGYEKLDFNLNDCHKMIDFFKSSIQKHKDWKNFGFRFSPTYTYDSIDAFYREVEAQGYNITFTEIDESIIDRFVEEGKLYLFRIHNKDFSPFSKGRPNLHTLYWKAIFSPENLKNVIYKLNGQAEVFYRRKSIQPEQMVIHKSGEAIDNKNPLTGKKQSTFHYDLIKDKRYTVDKFQFHVPITLNFKASESNIINYEVLQYLRTQPDVHIIGLDRGERNLIYLSLINQKGELLYQEPLNALKSDKFNVVTNYQELLARREKERDMARKSWGTIENIKELKEGYLSGVVNKIATLMVKHNAILVMEDLNTGFKRGRFKIERQVYQKLEKMLIDKLNYLVFKDKSEDEPGGLFKALQLTNKFKSFKEIGKQNGFIFYVPAWNTSKIDPTTGFVNLFYIHYENMEKARAFFGKFQSISYNHDKGYFEFAFDYNDFTTKAEGCRTNWTVCTHGDRIRAFRNPEKNHQWDYKTIHITEEFMALFRKYGIEFSGNKDLREIITGQKDAAFYKSLLDLFRLTLQMRNTNQDWDYLISPVLNENGEFYDSRKADNHLPQDADANGAFHIAKKGLMWLKQIQQFEGDNWKRLDLDKTNKGWLGFAQGYQF

SEQ ID NO: 61936 - protein, 852 aa, Unknown
  Microbial Source - UPSJ01002360.1_o | activated sludge metagenome genome assembly
LKENSHPVVDYFINHFKAKKKEETDKDFDLIANIDAKYSCIKGLLNTPYPEDKKLYQRSKEDNDIDNIKAFLDALMELLHFVKPLALSNDSTLEKYENFYSHFEPYYEQLELLIPLYNKVRNFAAKKPYSTEKFKLNFDNATLLNGWDKNKETDNTSVILRKDGLYFLAIMPQDNKNVFKDSPDLKANEICFEKMDYKQMALPMGFGAFVRKCFGTASQLGWNCPESCKNEEDKIIIKEDEVKNNRAEIIDCYKDFLNIYEKDGFQYKEYGFDFKESNKYESLREFFIDVEQQGYKITFQNISENYINQLVEDGKLYLFQIYNKDFSPYSKGKPNMHTLYWKALFDPENLKDVVYKLNGQAEVFYRKKSIEQKNIVTHKANEPIDNKNPKAKKKQSTFEYDLIKDKRYTVDKFQFHVPITLNFKATGNDYINQDVLTYLKNNPEVNIIGLDRGERHLIYLTLINQKGEILLQESLNTIVNKKYDIETPYHTLLQNKEDERAKARENWGVIENIKELKEGYISQVVHKIAKLMVEYNAIVVMEDLNTGFKRGRFKVEKQVYQKLEKMLIDKLNYLVFKDKDPSEVGGLYHALQLTNKFESFSKIGKQSGFLFYVPAWNTSKIDPTTGFVNLFNTKYESVPKAQEFFKKFKSIKFNSAENYFEFAFDYNDFTTRAEGTKTEWTVCTYGDRIKTFRNPDKVNQWDNQEVNLTEQFEDFFGKNNLIYGDGNCIKNQIILHDKKEFFEGLLHLLKLTLQMRNSITNSEVDYLISPVKNNKGEFYDSRKANNTLPKDADANGAYHIAKKGLVLLNRLKENEVEEFEKSKKVKDGKSQWLPNKDWLDFVQRNVEDMVVV

SEQ ID NO: 61937 - protein, 479 aa, Unknown
  Microbial Source -YNPsite07_CeleraDRAF_scf1119010704098 | GENOME_ACCESSION
MLEYKLAWKGGRLIVVPPQNTSRTCPCCGHVLSDNRQTQAWFECVACGYENHADRGSGPEAFRGSGPEAFRGSGPEAFRGSGPEAFRGSGPEAFRGSGPEAFRGSGPEAFRGSGPEAFRGSGPEAFRGSGPEAFLVGAINILARGIQLLRDEGQDTTDAAVGMRVGEPPVSARMACGSNCTGGRKQEPAETTAQGAIHAQRGRNLRPSGRGGCQHSLPSGSAQVRIKKQRSHPQAHFCLPVNPVRTLSATKAAFFSAYPRPINAVYRRVVEELLVELHLTTVNSTFVYDPFFALGLVTLYDGLMEAYHPPEQREAIFNALCKALHLKPEVLRKNARDLLELMGSGDPRQRLDLLCLKPEAEDVGGLKAILERMTQPPYAYSRVLAVGLYTAYEVVAKSLYEEPEERTRRFLENVVSKLPFSTERVRKDLELYRSSLDRMKQARAVVEEMVKAARRQQERRQSAASLPETSFGDPSKPGS

SEQ ID NO: 61938 - protein, 1108 aa, Unknown
  Microbial Source - Ga0065721_10050166 | GENOME_ACCESSION: BioRi_2199352012_$F_3300005286 GENOME_ID: 23829 CONTIG_ID: 14524
MAIRSIKLKLKTRTGPEAQNLRKGIWRTHRLLNEGVAYYMKMLLLFRQESTGGQTKKELQEELIRHIREQQQKNRADKNMQALPLDKALEALRQLYELLVPSSIGQSGDAQIISRKFLSPLVDPNSEGGKGTSKAGAKPTWQKKKEANDPTWEQDYEKWKKRREEDPTASVITTLEEYGIRPIFPLYTNTVADIAWLPLQSNQFVRTWDRDMLQQAIERLLSWESWNKRVQEEYSKLQEKMTQLNEQLEGGQEWISLLEQYEEQREQELIENMTAANDKYRITKRQMKGWNELYEQWSTVLPNASHEQYREALKRVQQRLRGRFGDAHFFQYLMKEEHHLIWKGNPQRIHYFVARNELKKRLEEAKQNATMTLPDARKHPLWVRFDARGGNLQDYYLTAEADNPRSRRFVTFSQLIWPNESGWMEKQDVEVELALSKQFYQQVTLQKNDKGKQEIEFKDKGSGSTFSGHLGGAKLQLERGDLEKEEKDFEGGEIGSVYLNIVIDFEPLQEVKNGRLQSPYGQVLQLVRRPNEFPKVTTYKSEELVEWMKASQNHSSGVESLESGFRVMSIDLGLRTAAATSIFSVEESNDANAAGFSYWIEGTPLVAVHKRSYMLKLPGEQVEKQVREKRDERQDQQRRVRFQIRILSQVIRMAKKQNRERADELDHLSQALEKQKSLLDQTDRTFWNGIVCDLTDALREKEGGWEQAVVQIHRKAEEHVGKVVQAWRKRFDADERKGIAGLSMWSIEELDSLRKLLISWSRRTRNPQEINRFEQGHTSHQRLLTHIQNVKEDRLKQLSHAIVMTALGYVYDEKKLEWFAKYPACQVILFENLSQYRSNMDRSTKENSTLMKWAHRSIPKYVHMQAEPYGIQVGDVRAEYSSRFHAKTGTPGIRCKMVKGQELQGKRFENLQKRLVNEQFLTEEQVKQLRPGDIVPDDSGEWFMTLSDGSEGKEVVFLQADINAAQNLQKRFWQRYNELFKVSCRVLIRGEEEYLIPKAKSVQAKLGKGLFVKKTDTVMKDVYVWDSQAKLKGKTTFTEESESPEQLEDFQEIIEEAEEAKGTYRTLFRDPSGVFFPEFVWNTQKDFWSEVKRRLYGKLRERFLMKTR

SEQ ID NO: 61939 - protein, 1355 aa, Unknown
  Microbial Source - Ga0255812_10583625 | GENOME_ACESSION: IMG_3300023203_$F_3300023203 GENOME_ID: 30040 CONTIG_ID: 32030
LTIQCAQGGRERIPSGALCRGKPRTPVTWRELVQCHSAEYNPARGGGKFFSDSEDINMATRSIKLKLALGKSKNEAEEARRAQLRSAVWTTHCLFNEGVAYYMNWLMLMRGEAFHKGQTEDELELIGISDGENYFFDKKQMNEEFLRRLKSQQKENGGDEENMPCSEKDPSKTLFADLYEIIVDMAGKKKAQDKKEEDKKAKDRGKKPQESSDTPPDNAENNEDETTEDARDEASLKKAASLAGTYLGFLTKKDSAAGERARIAVEKAPNWANALLANKKNEDRKRLVADWRNAILEWAGGKKDQSTSINGGGRTAAWPEAMKKWIERQNDPNAIEWKTALESKGWLTGYLNWLKGQKKHHDEFGPVGAKLRAAKLVPLFHKFTEHAKVDVKGNAEILDKSCFAEAIRRMGQFETNRIKMEKRKNELENKQKGRDQERNRIPQCLRDCLKEYEKERTRDLGRESLEPKEQYRIMPTGVRRFRQVVYAWNDCLSQNPAAPEDDLKRAAGNVHGRFRRRGFGDPKMFRTLAEAKFRPIWHFDEQNQFPPNWAQADKDTRRNLAQRQADALVKWAEANEADRDAQEARERPRLTIPDPINHPAWMRYEGAGGTNFSPVWFEQTGEGKDARTQLHLDLLEPLDPPKSDATWHVRRVASQSAGKKRKPQPNGSDTTIPIRNTEQIVLTKIGALKKDGKWAYQRLTLQDPSTREQFEGELKGSQLEFGAKGPRLNEENFIKQGFPPCFFSVVVNINTQKSESRPQSYADPIKNGPFKCKNMKPSEWNPDFLREGRRVLSLDLGIRHFAAYSVFRLTQTRPASNRQLFFMVWQRSDWYAVHEVSGCLKLEGEDETPDIIRRREALRNRRLELARAINLLHDLFSLGRLANSKEKQEELMELRNALSENNLPDKIRTMFPQDDLKALDDLAKEQNAPGWWKQEDDGPGECQGVCRIHRKWEETLGKEISEWRRERARFHHEIKEGKVPSGMGGLSFWRLEELDAERRLLLRWSLHSRKYGRRREDGTRPAIFVKSRARGIISGKQNVEWVDTDQRLLEHINNFKEDRRKVGANMIVMAALGYEFHDDRKGKKKDEAKWGQLRDECAHLPKPERARCDLILFENLGGYGFRKDRPRRENSKLMKWAHRSIPKEVMMQGQLFGLRVYDVLAQYSSRVYARNLSPGIRCHLVREVDLEPGSYYHAKWKEEINDTENQSVNKRTNLPKIGELVPEPLGEWFVTLAKDSNKIRICRVNADINAAWNLQRRFWTQEYINPFFQKNGRMFRDSSEIVVPHSEGENGWLPEEKFWEKANEIITDQLARQRATIYRCEQPSGDNCDPFEAEDLANSDGDMSSDDDATDQIRF

SEQ ID NO: 61940 - protein, 1089 aa, Unknown
  Microbial Source - Ga0265297_10015673 | GENOME_ACESSION: Munlanlwell13791_2_$F_3300029288 GENOME_ID: 280701 CONTIG_ID: 15672
MSVKSIELKLHIPYTEDGRKIVNAAGFTHYLHNKGVRYFMEKLLLLRQRDIYEDRGSNAPTRHMDDLKKGLLCYARARQLQNTGRHAGTDEEVLTLLQRMYEALIPAALREKGNTQSIAREWLNSLVSKDSNAGMGKSKSGRSPAYMKKGLTAERKALLKEKYENRQKEKIANEIRPSLKELGLLPFINTFRVDSCYTWLGEEKNGKVTPWDNSSVSCWERDMFQQALERLSTWESWNANADKEYEKAEAELSAWRQNNQDYLNNWQPKFTAYESKRKKEHDDVGFVSEQTFRINGRMLRGWDYIKDKWKNKLKSKPDMSQEDLLAIAKEYQAKRPRECGDMPLLEFLASIDMRGTWQGESDIVLRHLKHNTLIARFEIKHRYTIMTLPDPLKHPLWPRLDVPEGSNMNDYRLLPDGKKGWQVEFRLLFLRGNSQLVEQKLQLPVAPSGQLKFASLTAKPDAKGKHEDIRKISLIDQGTKEQFAAQFGGGRICLKRTLIENFRKAQDLFSKDVSPVYLNITLTVEDKQSISAKAFKWHRSNPAEPWYIVDIKDDTELVKPEYAGMGCLSVDLGVRQMAACSVFRLSKDRADEKRVSFSVVGAKDLYANSERSFLLALPGEKSDKAVKEARNSLWTKLRRLKYSLKLINQLIRLSGESTQKREEIYKGLVNAFTNPEENADPFLDKRLLINIESKISTPDEDWRNAVINIHMQWEVQFAKELAGWRKQFARDAKGRSRYKGIWGLSLDGIEYLESTRRLLISWTTHPRNAGEVKRLPKDKLFAVRLHRHIDGLKEDRIKKSADAIVMSTLGYTTGKEKKHEKCSLILFEDLSRYRFRTDRPRYENKRLMQWAHRAVVKETANQAGMYGIHVGLVGAGFSSRYYSRNMCPGIRCKALDKDDFASPGIAEILAEDKIDIKLLKPGNIVPWNGGELFAALDGKKPMLLHADINAAINLQRRFWTYYADQFRIVCGRLPQGTEVWFKPLRIGKRNERFFQKKSILQLPANTGSGLIGILRPFTAQKLQVIEENAVADLDGLNESEEDEAQASGHYIFFNDPSGNILPKERWYESKIFWTQVKQRLSAALLKKNS

SEQ ID NO: 61941 - protein, 1078 aa, Unknown
  Microbial Source - Ga0315280_10014676 | GENOME_ACESSION: YL17G06_40_MG_2_$F_3300031862 GENOME_ID: 281631 CONTIG_ID: 14675
MSVKSIAVKLVIPRSPGGVAIRRACAETHIIHNAGVRYFMENMLWLRQEDIYEDRDSVRPTRTRSFCQERLLRLAREVQRRNGFGKKASDPEILRLLRGVYEQIIPAAIGESSDNQAIARDWLGSLVSKASEAGLGKSARGRKPAWTELPDSDPRKSQRKHAYEERKKEQKSSQLRPRLKELGLLPLIPMFRSHSGYEWARVETKGKIQPWKDDNVSNWERDMFQQALERLSGWESWNKNAVERHRKAKETLTAWDRAHLQDSETWRPIFARYEASRRGELELGPLGLKRPFRIGRRMLRGWDRIREKWIDVLKKNHSISETDLLDFAKRWQQAHPREIGDMHFIAYLARPQNRAVWSGDHDYVVSQVHHNLLLIDSEEAHPWTILTLPHACIHPLWPRLDVPMGTNMNDYLIARGEDGGWHLTFSLLFPDGKRLTEKRLTLPVAHSGQLDYVRPVADSGRNLILRDPGTDEEFQGKWGGASVRRDRNLLQKLEDESAMRKAACGPVYISLTVDLMDRKGPSTKGFKKTPRGLAGEQFLIGIKEDSSANEILAIQNLGCLSIDLGLRQAAACSVFRMRTKPAQGRSSVPIAGLKRSMEHERSFLLALPGEQADEAVEDKRQKLWDELKKLSDSLGQLNRLIRLSGADGDSRSEGLAALEETETSIFDLKALAALKPKMDLGAVAWRGEVKRIHRCWEKDFAKALAGWRKSGTRDQKGRSRQFGIWGLSLEGIAYLERVRRLLIRWTTHPRKAEETNRLEKNRPFAARLQRHIDALKEDRIKKAADAVVMAALGYITEGEERKEKFEPCSIILVEDLERYRFRTDRPRQENSKLMQWAHRALFREIARQAGIFGIAVGKVGAGFTSRFHAATGAPGLRCAAVTKGLLRKPWFLKRLEEDGLDASSIQVGDIIPWERGKLFCTIDRAGKPVMIQADINAAQNLQKRFWANYDEPFRVVCAAGAADTFVPLPGKRLARFFASKMLAAVKPGDSPAYELVQAKVGRVEKQAVEEEGSMREEFPERLHEEDEAASARKTIFFRDPSGALLPAIRWYESKVFWSQVKQKVRQALLRPRKTAVTL

SEQ ID NO: 61942 - protein, 1127 aa, Unknown
  Microbial Source - Ga0206102_1000160 | GENOME_ACESSION: 1B1Ametagenome_2_$F_3300020149 GENOME_ID: 20785 CONTIG_ID: 159
MPVRSIKLKLMTHSGDNAAMLRKALWQTHKLHNEGVAYYMKLLIMLRQRDVYKQDLKEPAESFRLDLLAHVRQQQQRNGSAHIVIPEMELTAALRELYELLVPSHNGGKGDSQQLSRAFLSPLTDPNSQGLEGTAKAGAKPRWQKMQAEGHPDWEAEKERAEREKEADPARKIMKQLREWGLKPLFSLFTNEQTHIQWAPAKKDRDFVRTWDRDMFQQALERLLSWEQWNHKVIEERALVIARREAYESEHFASEAQQAWLQRMRGYELERAAKLAEQSLGLTGPFRIKSRQLRGWKRVHDLWRKLDKKGQRSLDHCWEAVAKIQGAQPKDFGDPELYRFLAEPANHDLWLEEPERLFHLVTYNALLEKEELSKQQTTLTLPDAVEHPLWVRFDPKGGNLHSYELQSEDDKSPQKHLSVTFARLIWPDSTGDGTPLWIESGPIQVGLATSAQFYRQFRLLPMGDDNRLGKALEVQDYSAADTKTTGLLGGAKLQFERPYVEKHWQTVSEGDIGRAYFNVTIDMEPIQPMKNDRLISGLGKAFKTFKRDFMEVTQYKPADLEAWMATQPAKTELTGTKALQEGLRVISVDLGQRTAAAVSVFEVVRGKPDADKLFYPIRDTESLYAVHRRSHLLQLPGEAVTPEAVSERQSRNRAMYGIRMQVRLLSGILRLYGKEEAASRRKSITRTMDMIRSTDNLSMDDKTRWSSVYQRLADAAELDVPLWQSTVITAHRELEAIVSQAFSTWRTSSRHRGRGVGGKSMWSLEELDQTRKLLISWSKRAREPHAINRLDRNERFAQRLLTHLQRLKADRLKETANLIIMAALGYKYDSPEKGWLPVFPACQLILFEDLSRYRFKMDRSRSENSKLMNWAHRSIPREVYMQGQVFGLMVGHVPSEFTSRFHARTGAPGIRCHVVTQADLDGRTAMLKLVDQDFLAEVRDELQPGDLLPFRGGEIFVSLNGSTEKERALNRLHADINAAQNLQRRFWSRYPQDPIRISAQRITADQEIAYEPKTTKMKESMGKGFFQEFEISKSHHVYKWNSSGKLGGKKRIADSKDMEETDDLAEEAAAAEELMDGYVTLFRDPSGYYRASDLWVPQVDFWGMVTRRLESLLKAAINERPGRALSR

SEQ ID NO: 61943 - protein, 1101 aa, Unknown
  Microbial Source - Ga0207869_1001742 | GENOME_ACESSION: HigsolAR5DSPAdes_$F_3300025517 GENOME_ID: 27181 CONTIG_ID: 1741
MSVKSIKLKLKTRSGTNSLSLRKGLWKTHELMNQGIAYYMEWLTLLRQEPVGSRSKEELRQELIGRLQEQRKRNGYSDSATELPDEVFLLLRELYECIVPSSVGESGDAQLLSRKYLSPLTDPDSEGGEGKSKAGRKPGWLLKKEAGDPTWEAEFLRAQKRKEADPTPRIMQALREFGIKPLFPLFTNLQSDITWLPPANKKQFVRTWDRDMFQQAIEKLLSWESWNRRVKDEREKLEQRKAKFEQEYLQDADGWLAPLQQFEKDREKELAEVAFAPGSVYLITPRQIRGWEKLYEKWEKLNTTTEADYIARIAEVQSSMPKEFGDPVVFRFLAKAENHHIWKGHKDRLFLLASYNQIKKQLQQAKEQAAFTLPDPVEHPLWIRFDARDGNLHDYVLWQESKRTRSRRTVTFSSLIMPSENGWCEQANVEVELALSRQFYRQIELCDNPKGKQEITFKDYSSGIPLKGHLGGAKIQFDRCHLEKNRDTLAEGNVGPVYLNVTVDIQPSQEIKNGRLQSPLGQALKVLAKDWPKVTEYKPSELESWILQSGQLQQTGIQSLTSGMRVMTVDMGIRTSAAVSIFEAVKEPPANSKKLCYKLPHCELYAVHRRSFLLNMPGERPDRRVKEQREKRTAERYAIRSQIRLLAQVNRLYAKETVFEQKQAIDEMVDAIQRNKNLAESVRNTWVKELGRLSACAGYQQDVWEKEVSEVYKRLEYITGEIVGKWRRSFGKGRKNLAGLSLWNIEELDSLRKLLISWSKRSRRPGEVNRLQENEKFAVELLEHIRQVKDNRLKQMANLIVMTALGYVYDETQREWIEKYPACQLILFENLQRYRFKQDRSRKENSQLMKWAHRSIPKTVWMQGEPFGLQVGDVNSEFSSRFHAKTGAPGIRCHMLTEPETRDSFLKEMIVKKGFLNEQEVELLKAGDIIPMQGGELFVTLKEKAGEELLIVHADINAAQNLQRRFWHQNAEVFRVVCQAGKTAKGEEVYIPKYKLAEKHLGKGLFRKQSETEDEHVYIWDNKAKIKGKTLSDDSLELEDEDEGLESLEEAKEARGEYKTLFRDPSGFFFPQDTWRPQVEFWSIVKSRLEKRLKMMILQKR

SEQ ID NO: 61944 - protein, 1129 aa, Unknown
  Microbial Source Ga0209347_1001125 | GENOME_ACESSION: AutmicBR23SPAdes_$F_3300027640 GENOME_ID: 23478 CONTIG_ID: 1124-
MTVRSIKLKMKTQTDPESLQLRKALWKTHQLLNEGVAYYMYWLILLRQDSYINEEGREYKKEEIQKELLEKVSGQQKRNDWQGDLGSLDILIPLRKLYELIVPSSIGEKGDSQISARKYLSPLVDPDSQGGKGTAKSGRKPRWQKMKEDGNPEWEEEYKKDMTKKESDPTTSILTELENYGLKPLIPLFTEEIKDIAWLPRKRGFVRTWDRDMFQQAIERLLSWESWNIRVKEEKQKIEQAIEDYRNKYLQDGEEWISKLREIEKIREAEITDVSYATKQGYLITRRELKGWEKVYEKWSKLIDAPLYDLKKVVTDVQNSMRREFSSAIFNILAEKKNRDIWVGQPNRLLHFAAYNVLLRKLQKAKDQATLTLPDPVNHPLWIRYDARGGNIHSYTIFQVDKMEVKVNLERMVWPNDSTWIEKEDITVHLAPSEQLYRQIAVQDNPSGKQEIDFIDYSSRVPLKGELIGSKIQFDRRYLENHTEELLAGNIGPVYLNLGVEVKHYQEMKNGRLRTPIGQSFTVKSLEWQKVIGFKAKELAEWMEQTAETNEKGIDSITEGLRIMSIDMGIRTSATVSVFEVVKNQPDNNKLFYKIQDTDLFAVHCRSILLNLPGEQVSKDIIKERDERYTERRFIKSQIRLLSKILQLNNQETQDGRKNILIGMIDTIESNKSLLNDQKQAWISKFNILAKNAYLDQVGWKQKLIEIHHEIEPVVGKLVSEWRRSFSKNQKNNKNRKNLAGLSMWNIDELEDTRRTLSSWSNRTRNPGEPKPIDPKFGINLLTHIQNLKDDRLKQMANLIVMTALGYKYDPGEKQKEERWKKAYPACHVILFEDLSRYRFNLDRTRLENSKLMKWGHRSIPKMVQMQGEIYGLLVGDVYSAFSSRFHAKTGAPGIRCHSLDEEDVNMLKNVSEIGGFDKLEDFKDLKREYYKLFGSVDKDYLAKMIERSDLIKSGTIIPKEGGELFITLAGHYKSNPKLSIIHADINAAQNLQRRFWQSNSEIFRVSCKLVKMSDGEYYIPKYSSKTFEKAMGKGRFIKNLDSEVYKWGNSSKMRIKTISTDKEIEFEEMEDFEQALEDAQEIQDGFKTMFRDPSGFFLATDKWLPQKEFWSMVKTVIHSRLRESSFSK

SEQ ID NO: 61945 - protein, 1147 aa, Alicyclobacillus kakegawensis
MAVKSIKVKLRLSECPDILAGMWQLHRATNAGVRYYTEWVSLMRQEILYSRGPDGGQQCYMTAEDCQRELLRRLRNRQLHNGRQDQPGTDADLLAISRRLYEILVLQSIGKRGDAQQIASSFLSPLVDPNSKGGRGEAKSGRKPAWQKMRDQGDPRWVAAREKYEQRKAVDPSKEILNSLDALGLRPLFAVFTETYRSGVDWKPLGKSQGVRTWDRDMFQQALERLMSWESWNRRVGEEYARLFQQKMKFEQEHFAEQSHLVKLARALEADMRAASQGFEAKRGTAHQITRRALRGADRVFEIWKSIPEEALFSQYDEVIRQVQAEKRRDFGSHDLFAKLAEPKYQPLWRADETFLTRYALYNGVLRDLEKARQFATFTLPDACVNPIWTRFESSQGSNLHKYEFLFDHLGPGRHAVRFQRLLVVESEGAKERDSVVVPVAPSGQLDKLVLREEEKSSVALHLHDTARPDGFMAEWAGAKLQYERSTLARKARRDKQGMRSWRRQPSMLMSAAQMLEDAKQAGDVYLNISVRVKSPSEVRGQRRPPYAALFRIDDKQRRVTVNYNKLSAYLEEHPDKQIPGAPGLLSGLRVMSVDLGLRTSASISVFRVAKKEEVEALGDGRPPHYYPIHGTDDLVAVHERSHLIQMPGETETKQLRKLREERQAVLRPLFAQLALLRLLVRCGAADERIRTRSWQRLTKQGREFTKRLTPSWREALELELTRLEAYCGRVPDDEWSRIVDRTVIALWRRMGKQVRDWRKQVKSGAKVKVKGYQLDVVGGNSLAQIDYLEQQYKFLRRWSFFARASGLVVRADRESHFAVALRQHIENAKRDRLKKLADRILMEALGYVYEASGPREGQWTAQHPPCQLIILEELSAYRFSDDRPPSENSKLMAWGHRGILEELVNQAQVHDVLVGTVYAAFSSRFDARTGAPGVRCRRVPARFVGATVDDSLPLWLTEFLDKHRLDKNLLRPDDVIPTGEGEFLVSPCGEEAARVRQVHADINAAQNLQRRLWQNFDITELRLRCDVKMGGEGTVLVPRVNNARAKQLFGKKVLVSQDGVTFFERSQTGGKPHSEKQTDLTDKELELIAEADEARAKSVVLFRDPSGHIGKGHWIRQREFWSLVKQRIESHTAERIRVRGVGSSLD

SEQ ID NO: 61946 - protein, 1115 aa, Alicyclobacillus hesperidum
VTVRSIRVKLAVGSPQYRDVRRGLWKTHEIMNQGVRYYCEWLVLMRQEPIYDEDEHGLTVVQRTREDIQAELLSRLRTLQSAHQHSGDMGTDEELLSLMRQLYEQLVPSSVDKNKSGDARMIARNFFNPLTNPNSQGGLGISNAGRKPKWLLKKLSGDPTWEEDYKKAMEQKQESSVSFLLLELRRFGLHPIFLPYTDTVLEVSWAPKKARQWVRKWDYDLFQQSIERMLSWESWTRRVKERFEKLVESEKKFYDENFATDPEFIKLAETLEGELQASSQGFVAVDEHAFQIRPRSMRGFDRVADEWCKLADDAPIEEYEAAIKRVQARLGRNFGSYVLFAHLAKPEYWSLWRSDPTKILRFARLRALQRAVARAKRHARLTLPDAIHHPIWIRYDAKGKNIYSYRLLIPEKRSKRYYVEFSSLIMPDGENRWAEHRNIRVPLAFSRQWERLHFSIMEDGSLCVQYRDPGVDEPLRAELGGAKIQFDRRYLIRRSSTLSAGECGPVYLNVSVDVNPAHRPDVQVLQSAKLVSVSRDTNRIYLRPENLSAYWKSQGDGTLPLRVMSVDLGVRSSAAVVICRLEHRDSVVSSGRRTATIYRIAGTDEFVAVQERAFLLRLPGEGKGTNEDAPLRDVYAQLGTIRQGIQILRSLLRLCDTKTPDERQEALHGLAQSLEPSGAWKDELHPHLVMLQGVVHDSVDNWKQKVISVHRQMERILGHAVREWKVARKNAGKPPIRRGAGGLSLRRIRQLEQERRTLVAWSNHAREPGQVVRIKRGTQVAQWLVERVNHLKEDRLKKLADLLIMTALGYVYDETKPSGHKWDKRYPPCQIILMEDLSRYRFQSDRPPSENSQLMAWSHRRLLEILKLQADLHKLIVGTVFPAFSSRFDAQSGAPGVRCRSVKKQDIENAAQGKGWLARELQRLNWTLEWLQPNDLIPTGDGELFVTPACCDRQKGIKIVHADLNAAQNLQRRFWGGHAESLCRVTCDVVERDGRRYAVPRISNAFADSFYKVFGQGVFVSTDEEDVYRWMVGEKISSRGRSRGRTSDEEAEAETWIDEAREQQGKVIALFRDASGQIHGGDWLVAKVFWGWVERLVTARLLSRMSEREAAAHKE

SEQ ID NO: 61947 - protein, 1463 aa, Unknown
  Microbial Source - GENOME_ACESSION: OQOO01.1 GENOME_ID: 9995 CONTIG_ID: 420
MPKQDKPSVTQRAYTLRLRGADPSDTSWRDALWRTHEAVNKSAKAFGDWLLTLRGGLDHTLADARVKGGKGKPDRDPADAERKARRILLALSWLSVESKLGAPEGYIVASGEEAPENRNGKVVAALEEILKNRNLADNEIGEWKKDCSSSLSAAIRGDAVWVNRSKAFDEAVKSIGCSLTRDEVWDMLERFFGSRDAYLAPAKGSEDESSETEQGNKAKDLVQKAGQWLSSRFGTGKGADFCRMADVYGKIAAWAGANKSNGSATVDDLAKELQKELQIEESKATDGLDWIIKLSSYPGHSPNPVHELLRQNPKLARSNLDDLEKTANTRAESCRSKIGSKGQRPYSDAVLKDVEAVCEFTYLQKDGPARHSEFTVILDHAARRVSLAHTWIKRAEKERSKFEEDAKKIGQVPKAAKDWLHKFCTERSQASGALEPYRIRRRAVDGWKEVVAAWSERSCNTSADRIAAARALQDDPEIDKFGDIQLFEALAEDDAACVWHKDGDAAKAPDPQPLIDYALAAEAEFRKRHFKVPAYRHPDALLHPVFTDFGESRWKICFDVHENLETASPHALSLKLWTGSEVVPVPLRWQSKRLARDLALGQDAQKDGALEVARADRLGRAASNVTKSDEVKISGLFEQADWNGRLQAPRRQLEAIAVVRDNLSLSDQERERRMSGMMDRIRWLVTFSAKLQPQGPWYEFAKTNQLRIDLQDWPHADSNKTRKGHARLILSRLPGLRVLSVDLGHRYAAACAVWEAVNAEQVEEACKDAGHEAPNANDLYLHLKRKATKKQKKDKKIEVEKTTIYRRIGADTLPNGTPHPAPWARLDRQFLIKLQGEKEGVREASNEEVWKVHQLETELGRTTPLIDRLVASRWGGSDKQIARLEELKKLGWNSAEKSDPNGESDEGESRRPSLSVDELMSSAVRTMRLALKRHGDRARIAHYLITDEKTKPGGTKEKLDESGRVDLLQDALVMWHDLFSSHGWEDKAAGQLWGEHVAKLSEYKAPEEIDEGSSVIERKKKQKENREKLYDVAEALAQDETLRKALHDAWKKRWEEDDEQWKKRLRWFKDWILPRGKAANDPAIRKVGGLSLPRLATLTEFRRKVQVGFFTRLHPDGTRAEAKEQFGQKTLDALEHLREQRVKQLASRITEAALGIGSEGGKGWDGGKRPRQRIDDPRFAPCHAIVIEDLTRYRPEETRTRRENRQLMSWSSSKVKKYLAEACQLHGLHLREVSASYTSRQDSRTGAPGIRCQDVPVDEFMRSPFWRHQIAQAEKKQSGGKGDARERFLCDLNARWKDKSEADWKKAGAVRVPLKGGEIFVSADPASLAAKGLQADLNAAANIGLRALIDPDWPGKWWYVPCDPVSFRPIKDKVAGSAAVKLDQALRQPAQAQSGDAKAKKKREKKDAGKPQEVVNLWRDISSSPLGESGEWKEYAAYRNQVQVRVVDILRRAVCSKNNREKQ

SEQ ID NO: 61948 - protein, 1122 aa, Unknown
  Microbial Source - GENOME_ACCESSION: OWPA01.1 GENOME_ID: 12159 CONTIG_ID: 246
MTNSDSVELRKGLWATHELLNKGVAYYMEWLILLRQDTIKMPEGVIKPKEAIQSELLQRVKAQQLLNNHQDKAEEESEVLAVLRQLYELIVPSSVGGTGDAQMLARKFLSPLVDPNSEGGKGTSKAGRKPRWKILKEQGDPRWEEEYEKDCARKEADETSKVLFKLEELGLKPLFPLFTDTRKDINWLPKANRQFVRNWDRDMFQQAVERLLSWESWNRRVADAKSKLEEKATEYYDKYLSSVTETVQKLKRYERERAVELEQTTGNKSDSYRISIRSVRGWDRIYPLWLKRSVNATPTELRDILKSVQREMSEGFGDPQLFIYLAQPENRDIWYGSNEKARILNHYAIYNGILTKLEQAKEQATFTMPDPIDHPLWVRFDARGGNLYTYILEEDEGWRVQFERLLWPNERGWEEREKVNVKVAPSKQLVRKAKNGYQKIIELVNNPKGKQEVIYRDYSTMLPFDGVLGGAKIQLNRYYLEKSKEKIARGQIGSVYLNISLEVTPIQEVKNGRLQTPLGKALTIVKSDWPKIVDFKSEQLQQMLTEQNSNKGDLKGVRSLAEGLRVMTIDLGQRASAAVSIFEVTAERPSDEKTKLFFAIPDTPLYAVHRRSLLLNLPGESPDKETEQRRKDRYSSYRAIRFQVRMLAQILKLHTKETSEERLTELQSFLKAVTEYELWDDEIKSLWKQELNKLRKSVNQSNEEWVQEIVLTHRSLESRVAKNISNWRKSLSNKRGGFLANSRYKIAGLSLWNVDDLTRNRRLLLSWSKRSRIPGKMNHLQHEERFGLHQLVHLQNVKNDRLKQLANLIVMTALGYTYDQERKVWLETYPACQVILFEDLSRYRFKLDRPRRENSQLMKWAHRSIPKTVAMQGEIYGLQVGDVYAAFSSRFHARTGTPGIRCKQLKECDLNDSFIKEALIRDKFITEEKWSSLKAGDIVPWKGGELFATLEKNASDKNGSKLLLIHADINAAQNLQRRFWNHRSELFRIACRRTKINDGEVYVPTSQSERWKKQMGKGYFVKDNNYSGRDNELEKVEAYEWNNMERIRQEVVSIDETIELEDMEEINQAIEEELESKGDYVTLFRDPSGVIFPDYLWIPQVQFWSVVKNKIQKELHKRIFGN

SEQ ID NO: 61949 - protein, 1112 aa, Bacillus sp.
MAIRSIKLKMKTNSGTDSIYLRKALWRTHQLINEGIAYYMNLLTLYRQEAIGDKTKEAYQAELINIIRNQQRNNGSSEEHGSDQEILALLRQLYELIIPSSIGESGDANQLGNKFLYPLVDPNSQSGKGTSNAGRKPRWKRLKEEGNPDWELEKKKDEERKAKDPTVKIFDNLNKYGLLPLFPLFTNIQKDIEWLPLGKRQSVRKWDKDMFIQAIERLLSWESWNRRVADEYKQLKEKTESYYKEHLTGGEEWIEKIRKFEKERNMELEKNAFAPNDGYFITSRQIRGWDRVYEKWSKLPESASPEELWKVVAEQQNKMSEGFGDPKVFSFLANRENRDIWRGHSERIYHIAAYNGLQKKLSRTKEQATFTLPDAIEHPLWIRYESPGGTNLNLFKLEEKQKKNYYVTLSKIIWPSEEKWIEKENIEIPLAPSIQFNRQIKLKQHVKGKQEISFSDYSSRISLDGVLGGSRIQFNRKYIKNHKELLGEGDIGPVFFNLVVDVAPLQETRNGRLQSPIGKALKVISSDFSKVIDYKPKELMDWMNTGSASNSFGVASLLEGMRVMSIDMGQRTSASVSIFEVVKELPKDQEQKLFYSINDTELFAIHKRSFLLNLPGEVVTKNNKQQRQERRKKRQFVRSQIRMLANVLRLETKKTPDERKKAIHKLMEIVQSYDSWTASQKEVWEKELNLLTNMAAFNDEIWKESLVELHHRIEPYVGQIVSKWRKGLSEGRKNLAGISMWNIDELEDTRRLLISWSKRSRTPGEANRIETDEPFGSSLLQHIQNVKDDRLKQMANLIIMTALGFKYDKEEKDRYKRWKETYPACQIILFENLNRYLFNLDRSRRENSRLMKWAHRSIPRTVSMQGEMFGLQVGDVRSEYSSRFHAKTGAPGIRCHALTEEDLKAGSNTLKRLIEDGFINESELAYLKKGDIIPSQGGELFVTLSKRYKKDSDNNELTVIHADINAAQNLQKRFWQQNSEVYRVPCQLARMGEDKLYIPKSQTETIKKYFGKGSFVKNNTEQEVYKWEKSEKMKIKTDTTFDLQDLDGFEDISKTIELAQEQQKKYLTMFRDPSGYFFNNETWRPQKEYWSIVNNIIKSCLKKKILSNKVEL

SEQ ID NO: 61950 - protein, 1108 aa, Brevibacillus agri
MAIRSIKLKLKTHTGPEAQNLRKGIWRTHRLLNEGVAYYMKMLLLFRQESTGERPKEELQEELICHIREQQQRNQADKNTQALPLDKALEALRQLYELLVPSSVGQSGDAQIISRKFLSPLVDPNSEGGKGTSKAGAKPTWQKKKEANDPTWEQDYEKWKKRREEDPTASVITTLEEYGIRPIFPLYTNTVTDIAWLPLQSNQFVRTWDRDMLQQAIERLLSWESWNKRVQEEYAKLKEKMAQLNEQLEGGQEWISLLEQYEENRERELRENMTAANDKYRITKRQMKGWNELYELWSTFPASASHEQYKEALKRVQQRLRGRFGDAHFFQYLMEEKNRLIWKGNPQRIHYFVARNELTKRLEEAKQSATMTLPNARKHPLWVRFDARGGNLQDYYLTAEADKPRSRRFVTFSQLIWPSESGWMEKKDVEVELALSRQFYQQVKLLKNDKGKQKIEFKDKGSGSTFNGHLGGAKLQLERGDLEKEEKNFEDGEIGSVYLNVVIDFEPLQEVKNGRVQAPYGQVLQLIRRPNEFPKVTTYKSEQLVEWIKASPQHSAGVESLASGFRVMSIDLGLRAAAATSIFSVEESSDKNAADFSYWIEGTPLVAVHQRSYMLRLPGEQVEKQVMEKRDERFQLHQRVKFQIRVLAQIMRMANKQYGDRWDELDSLKQAVEQKKSPLDQTDRTFWEGIVCDLTKVLPRNEADWEQAVVQIHRKAEEYVGKAVQAWRKRFAADERKGIAGLSMWNIEELEGLRKLLISWSRRTRNPQEVNRFERGHTSHQRLLTHIQNVKEDRLKQLSHAIVMTALGYVYDERKQEWCAEYPACQVILFENLSQYRSNLDRSTKENSTLMKWAHRSIPKYVHMQAEPYGIQIGDVRAEYSSRFYAKTGTPGIRCKKVRGQDLQGRRFENLQKRLVNEQFLTEEQVKQLRPGDIVPDDSGELFMTLTDGSGSKEVVFLQADINAAHNLQKRFWQRYNELFKVSCRVIVRDEEEYLVPKTKSVQAKLGKGLFVKKSDTAWKDVYVWDSQAKLKGKTTFTEESESPEQLEDFQEIIEEAEEAKGTYRTLFRDPSGVFFPESVWYPQKDFWGEVKRKLYGKLRERFLTKAR

SEQ ID NO: 61951 - protein, 1108 aa, Brevibacillus gelatini
MAIRSIKLKLKTNTGPEAQNLRKGIWRTHRLLNEGVAYYMNMLLLFRQESTDKKTKQEIHEELIRHIRAQQQRNHADEKTQALPLEKALEALRKLYELLVPSSVGQSGDSQIISRKFLSPLVDPNSEGGKGTSKAGAKPAWQKKKEANDPTWKQDYEKWKKRREEDPTASVITTLEEYGIRPLFPLYTNTVAEIAWLPLKSGQFVRTWDRDMFQQAIEGMLSWESWNRRVQEEYAKLEGKMAQLNEQLEGGEEWIRLLEQYEEKREQELRENMTAANDKFRITKRQMKGWKELYEVWSTFLPSASQEQYKEAIKRVQQRLRGKFGDFHFFQYLSEEENRLIWKGNPQRIHYFVARNELTKKLEKAKQSARRTLPDANKHPLWVRYDARGGNLQDYYLTAESDKPRSRRFVTFSQLIWPSESGWLEKKDVQAELALSRQFYQQVTFLKNDKGKQEIEFKDKGSGTTFSGHLGGAKLQLERSVLENKERKFEEGEIGKAYLNVAIDFKPLQEVKNGRVQAPYGQVLQLIRLPNAFPKVRTYKSEELVEWIKASPQHLSGVESLASGFRVMSIDLGLRAAAATSIFSVEESSDKNATKLAYWIEGTPLVAVHQRSYMLRLPGEQVEQHVWEKRDERGDQHKRVRFQIRRLAEIIRLANKQYGDRWDELNRLDEAVSKEKSPLDQADRTFWEGIVSDLTTALPLNDADWTEAVVQIHRKAELYVGKVVQAWRKRFNADERKGIAGLSMWSIEELDGLRKLLISWSRRTRNPQEVNRFEPEHTGHKRLLTHIQNVKKDRLKQVSHAIVMTALGYIYDEKKQKWCAKYPACQVILFENLSQYRSNLDRSAKENSTLMKWAHRSIPKYVHMQAEPYGIQIGDVRAEYSSRYYAKTGTPGIRCKKLREHDVKGWRLDHLKKRLVNEQFLTEAQVEQLKAGDIIPDDSGELFMTMTDGSGGKEIVFLQADINAAQNLQKRFWQRNSELFKVSCRVIVRDEAEYLVPQAKKVQEKLGKGVFVKKSDTAWKEVYVWDSQAKLKGKTTFTEESESPEQLEDLQEMIEEAEEAKGTYRTLFRDPSGVFFPDFVWNTPKDFWGEVKRKLYGKLRERLLTKVR

SEQ ID NO: 61952 - protein, 1129 aa, Unknown; identical to SEQ ID NO: 61900
  AacCas12b

SEQ ID NO: 61953 - protein, 1129 aa, Unknown
  AapCas12b
MAVKSMKVKLRLDNMPEIRAGLWKLHTEVNAGVRYYTEWLSLLRQENLYRRSPNGDGEQECYKTAEECKAELLERLRARQVENGHCGPAGSDDELLQLARQLYELLVPQAIGAKGDAQQIARKFLSPLADKDAVGGLGIAKAGNKPRWVRMREAGEPGWEEEKAKAEARKSTDRTADVLRALADFGLKPLMRVYTDSDMSSVQWKPLRKGQAVRTWDRDMFQQAIERMMSWESWNQRVGEAYAKLVEQKSRFEQKNFVGQEHLVQLVNQLQQDMKEASHGLESKEQTAHYLTGRALRGSDKVFEKWEKLDPDAPFDLYDTEIKNVQRRNTRRFGSHDLFAKLAEPKYQALWREDASFLTRYAVYNSIVRKLNHAKMFATFTLPDATAHPIWTRFDKLGGNLHQYTFLFNEFGEGRHAIRFQKLLTVEDGVAKEVDDVTVPISMSAQLDDLLPRDPHELVALYFQDYGAEQHLAGEFGGAKIQYRRDQLNHLHARRGARDVYLNLSVRVQSQSEARGERRPPYAAVFRLVGDNHRAFVHFDKLSDYLAEHPDDGKLGSEGLLSGLRVMSVDLGLRTSASISVFRVARKDELKPNSEGRVPFCFPIEGNENLVAVHERSQLLKLPGETESKDLRAIREERQRTLRQLRTQLAYLRLLVRCGSEDVGRRERSWAKLIEQPMDANQMTPDWREAFEDELQKLKSLYGICGDREWTEAVYESVRRVWRHMGKQVRDWRKDVRSGERPKIRGYQKDVVGGNSIEQIEYLERQYKFLKSWSFFGKVSGQVIRAEKGSRFAITLREHIDHAKEDRLKKLADRIIMEALGYVYALDDERGKGKWVAKYPPCQLILLEELSEYQFNNDRPPSENNQLMQWSHRGVFQELLNQAQVHDLLVGTMYAAFSSRFDARTGAPGIRCRRVPARCAREQNPEPFPWWLNKFVAEHKLDGCPLRADDLIPTGEGEFFVSPFSAEEGDFHQIHADLNAAQNLQRRLWSDFDISQIRLRCDWGEVDGEPVLIPRTTGKRTADSYGNKVFYTKTGVTYYERERGKKRRKVFAQEELSEEEAELLVEADEAREKSVVLMRDPSGIINRGDWTRQKEFWSMVNQRIEGYLVKQIRSRVRLQESACENTGDI

SEQ ID NO: 61954 - protein, 1090 aa, Unknown
  BrCas12b
MPVRSFKVKLVTRSGDAEHMLQLRRGLWKTHEIVNQGIAYYMNKLALMRQEPYAGKSREVVRLELLHSLRAQQKRNNWTGDAGTDDEILNLSRRLYELLVPSAIGEKGDAQMLSRKFLSPLVDPNSEGGKGTAKSGRKPRWMKMREEGHPDWEAEREKDRAKKAADPTASILNDLEAFGLRPLFPLFTDEQKGIQWLPKQKRQFVRTFDRDMFQQALERMLSWESWNRRVAEEYQKLQAQRDELYAKYLADGGAWLEALQSFEKQREVELAEESFAAKSEYLITRRQIRGWKQVYEKWSQLPEHAAQEQFWQVVADVQTSLPGAFGDPKVYQFLSQPEHHHIWRGYPNRLFHYSDYNGVRKKLQRARHDATFTLPDPVEHPLWIRFDARGGNIHDYEISQNGKQYQVTFSRLLWPENETWVERENVTVAIGASQQLKRQIRLDGYADKKQKVRYRDYSSGIELTGVLGGAKIQFDRRHLRKASNRLADGETGPVYLNVVVDIEPFLAMRNGRLQTPIGQVLQVNTKDWPKVTGYKPAELISWIQNSPLAVGTGVNTIEAGMRVMSVDLGQRSAAAVSIFEVMRQKPAEQETKLFYPIAVTGLYAVHRRSLLLRLPGEKISDEIEQQRKIRAHARSLVRYQIRLLADVLRLHTRGTAEQRRAKLDELLATLQTKQELDQKLWQTELEKLFDYIHEPAERWQQALVAAHRTLEPVIGQAVRHWRKSLRIDRKGLAGMSMWNIEELEETRKLLIAWSKHSRVPGEPNRLDKEETFAPQQLQHIQNVKDDRLKQMANLLVMTALGYKYDEAEKQWKEAYPACQMILFEDLSRYRFALDRPRRENNRLMKWAHRSIPRLVYLQGELFGIQVGDVYSAYTSRFHAKTGAPGIRCHALKEEDLQPNSYVVKQLIKDGFIREDQTGSLKPGQIVPWSGGELFVTLADRSGSRLAVIHADINAAQNLQKRFWQQNTEIFRVPCKVTTSGLIPAYDKMKKLFGKGYFAKINQTDTSEVYVWEHSAKMKGKTTPADPAEEGVFDESLTDEMEELEDSQEGYKTLFRDPSGFFWSSDRWLPQKEFWFWVKRRIEKKLREQLQ

SEQ ID NO: 61955 - protein, 318 aa, Unknown
  Microbial Source - Accession No. GA0272445_1000517
MLRRCEEEVVKFLNLSRLELQKMLYHKMKDAGVETSAYTLALLVQRFTGSLGEKAVIPFDTSYNAKFVSEDGVWFVEVQLLKGRGRRVRIPVAKTELPYYEALEELKDLPFIIVRENKDWFAYVSIPVQNSVNGEIVGVDFNLRRWVASPFEGPPLFFDAGEYMRGIDRLQRLRSRYQRRGEEDKWNECYREMRGIVKLAHGNFLARIREKYGVCTLAVEEVEVMYKLIRKDNKMINNWLYSKTALRQFTLRAMAKGFNVVEVDPKDTTKLCHKCGGQVKIYGKHDRLITCEKCGYKDYNRDLNSARNIAKKAQYVKE

SEQ ID NO: 61956 - protein, 1129 aa, Alicyclobacillus sp.; identical to SEQ ID NO: 61953

SEQ ID NO: 61957 - DNA, 91 bp, Artificial Sequence
  Synthetic
gtctagaggacagaatttttcaacgggtgtgccaatggccactttccaggtggcaaagcccgttgagcttctcaaatctgagaagtggcac

SEQ ID NO: 61958 - DNA, 91 bp, Artificial Sequence
  Synthetic
gtctaaaggacagaatttttcaacgggtgtgccaatggccactttccaggtggcaaagcccgttgaacttctcaaatctgagaagtggcac

SEQ ID NO: 61959 - DNA, 91 bp, Artificial Sequence
  Synthetic
gtctagaggacagaatttttcaacgggtgtgccaatggccactttccaggtggcaaagcccgttgaacttctcaaatctgagaagtggcac

SEQ ID NO: 61960 - DNA, 91 bp, Artificial Sequence
  Synthetic
gtctaaaggacagaatttttcaacgggtgtgccaatggccactttccaggtggcaaagcccgttgagcttctcaaatctgagaagtggcac

SEQ ID NO: 61961 - DNA, 91 bp, Artificial Sequence
  Synthetic
gtctagaggacagaatttttcaacgggtgtgccaatggccactttccaggtggcaaagcccgttgaacttctcaaatctgcgaagtggcac

SEQ ID NO: 61962 - DNA, 91 bp, Artificial Sequence; identical to SEQ ID NO: 61957
  Synthetic

SEQ ID NO: 61963 - protein, 1090 aa, Artificial Sequence; identical to SEQ ID NO: 61954
  Alicyclobacillus sp.

SEQ ID NO: 61964 - DNA, 125 bp, Artificial Sequence
  Synthetic
tgcaggttagtggaaatatagatagccgttgtgactgagtgacgtgttaggtcaccgtagcacatgacacaactgcactggtcagcctgtagctaaccaccttcattatatctagtttttccaac

SEQ ID NO: 61965 - DNA, 98 bp, Artificial Sequenc
  Synthetic
gttgtgactgagtgacgtgttaggtcaccgtagcacatgacacaactgcactggtcagcctgtagctaaccaccttcattatatctagtttttccaac

SEQ ID NO: 61966 - DNA, 61 bp, Artificial Sequence
  Synthetic
tgacacaactgcactggtcagcctgtagctaaccaccttcattatatctagtttttccaac

SEQ ID NO: 61967 - DNA, 99 bp, Artificial Sequence
  Synthetic
gaaggtggttagctacaggctgaccagtgcagttgtgtcatgtgctacggtgacctaacacgtcactcagtcacaacggctatctatatttccactaac

SEQ ID NO: 61968 - DNA, 120 bp, Artificial Sequence
  Synthetic
gttggaaaaactagatataatgaaggtggttagctacaggctgaccagtgcagttgtgtcatgtgctacggtgacctaacacgtcactcagtcacaacggctatctatatttccactaac

SEQ ID NO: 61969 - DNA, 73 bp, Artificial Sequence
  Synthetic
gtgcagttgtgtcatgtgctacggtgacctaacacgtcactcagtcacaacggctatctatatttccactaac

SEQ ID NO: 61970 - DNA, 63 bp, Artificial Sequence
  Synthetic
  misc_feature (37)..(63): n = any nucleotide
gtccgtttcgttagtggaaatgtagatggttagcacnnnnnnnnnnnnnnnnnnnnnnnnnnn

SEQ ID NO: 61971 - DNA, 52 bp, Artificial Sequence
  Synthetic
  misc_feature (26)..(52): any n = any nucleotide
tagtggaaatgtagatggttagcacnnnnnnnnnnnnnnnnnnnnnnnnnnn

SEQ ID NO: 61972 - DNA, 54 bp, Artificial Sequence
  Synthetic
  misc_feature (28)..(54): Any n = any nucleotide
gttagtggaaatctagatggttagcacnnnnnnnnnnnnnnnnnnnnnnnnnnn

SEQ ID NO: 61973 - RNA, 25 nt, Artificial Sequence
  Synthetic
gggaacaaagcugaaguacuuaccc

SEQ ID NO: 61974 - DNA, 18 bp, Artificial Sequence
  Synthetic
gggtagggcgggttggga

SEQ ID NO: 61975 - RNA, 12 nt, Artificial Sequence
  Synthetic
  misc_feature (1)..(1): Biotin tag = /5Biosg/
  misc_feature (12)..(12): Iowa black quencher = /3IAbRQSp/
ucucguacguuc

SEQ ID NO: 61976 - RNA, 24 nt, Artificial Sequence
  Synthetic
  misc_feature (1)..(1): biotin tag = /5Biosg/
  misc_feature (24)..(24): Iowa black quencher = 3IAbRQSp
ucucguacguucucucguacguuc

SEQ ID NO: 61977 - DNA, 55 bp, Artificial Sequence
  Synthetic
gaaattaatacgactcactatagggaggtttcaaactttacttgctttacataga

SEQ ID NO: 61978 - DNA, 30 bp, Artificial Sequence
  Synthetic
tcctaggttgaagataacccacataataag

SEQ ID NO: 61979 - RNA, 64 nt, Artificial Sequence
  Synthetic
gauuuagacuaccccaaaaacgaaggggacuaaaacgcagcaccagcuguccaaccugaagaag

SEQ ID NO: 61980 - DNA, 55 bp, Artificial Sequence
  Synthetic
gaaattaatacgactcactatagggcgaagttgtaggagacattatacttaaacc

SEQ ID NO: 61981 - DNA, 31 bp, Artificial Sequence
  Synthetic
tagtaagactagaattgtctacataagcagc

SEQ ID NO: 61982 - RNA, 64 nt, Artificial Sequence
  Synthetic
gauuuagacuaccccaaaaacgaaggggacuaaaacccaaccucuucuguaauuuuuaaacuau

SEQ ID NO: 61983 - DNA, 18 bp, Artificial Sequence
  Synthetic
gctgctgaggcttctaag

SEQ ID NO: 61984 - DNA, 21 bp, Artificial Sequence
  Synthetic
gcgtcaatatgcttattcagc

SEQ ID NO: 61985 - DNA, 40 bp, Artificial Sequence
  Synthetic
gcggccaatgtttgtaatcagtagacgtggtccagaacaa

SEQ ID NO: 61986 - DNA, 39 bp, Artificial Sequence
  Synthetic
tcagcgttcttcggaatgtcgctgtgtaggtcaaccacg

SEQ ID NO: 61987 - DNA, 22 bp, Artificial Sequence
  Synthetic
ccttgtctgattagttcctggt

SEQ ID NO: 61988 - DNA, 18 bp, Artificial Sequence
  Synthetic
tggcatggaagtcacacc

SEQ ID NO: 61989 - RNA, 111 nt, Artificial Sequence
  Synthetic
gucuagaggacagaauuuuucaacgggugugccaauggccacuuuccagguggcaaagcccguugagcuucucaaaucugagaaguggcaccgaagaacgcugaagcgcug

SEQ ID NO: 61990 - protein, 1129 aa, Alicyclobacillus acidiphilus; identical to SEQ ID NO: 61953
